United States Patent 10,407,724 (METHODS AND COMPOSITIONS FOR SCREENING AND TREATING DEVELOPMENTAL DISORDERS) - sequence listing, part 74

SEQ ID NO: 1954 - DNA, 76421 bp, Homo sapiens
ataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagt

SEQ ID NO: 1955 - DNA, 989815 bp, Homo sapiens
gaaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagtgacggacagggagctctgcgaattggcgcccggcaaggggtgctcaacggcgcgtgcgcagagggaggcaggcgggtgggctgccggcggtggactcgtcggagccgcgggcggtcaggtagggggcgggaaggagggttggggactggggaccgcggccggagtcgtgggccgtggctcagcggccaggcgggggaacgtgccggcgtgcagcggccgcgcccgaatggcagggtgtggggaccggatctggggggggcaggactagggtgggggtggggctgcgaggggcaggctcgggagggattcgtggggctgaggagatccgaggagatgcagctgggggaggggagcgaggggctctgaagagatttgcggttgcagcatctcgggaggtatgaggtaatgtcggggccctgaggaggaacggggtgtagcatgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtgaggaattggggcgttgaactgaggtgcggggctgagtgtggcagagatttggaaatagggattaaacgatctgagtccgagggatttggggcatatgagtgaggaattgacgagggttgcaatatacagccccaaagattggaatttggaattgtaagagggttggggacagggtttggagaggattgaatcgtggggtggagatgtcctaactgggctataaaatcaaaggaccctgagtagatttgtggattggtgtcttgggctgctaaagagattttccttaaatcgctgcatgggagacagagggagttcaggggacccaaggacctaaaagtaatgtatgaaactggatgagtatatgaagatgagcagagttcaggtgctgaggaacaaagtgataaatcttcagttcagataatcctgaaggagtgtggtaatccctgtgaagggcagaatcttcttcatttattaaacaaagatccgttatcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccctgggttcaagtcctagctctatctcttcctgactttaagtcctagctctatctcttcctgactttgtggccttgaatgagttacttaaccacccagtgccttggctcttcatctgtaaaatggggttatgataacaagaccaatgtcacagaattgttgtgaggatttagtgaagtaaactagcatgcctaggatctggcacatagtaagttctcaaaatctagtaatttttagtcttgtatctacttctttactcagttttcatgacagtccttctaagtaggctctactgtattcagttttacacatgaggaaactaaggcttaggaagtgacttgcctaagtttccatagctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatgtgcattatcttagtgaattcaatcctgctaacagtctaggttttattccttgtttacagataagaaaaataacaggttaaatgacttacccagggctacagagcaagtagctaggttgggatacaaacccagttctgtcttacacctatgttacattatagtagttttattagaagccttttccaacccttcagagcccctatgtttatgtctggagaatagttggaagccagaagtttataaggcccttaaagtagatcattgtctatgcacactgatgtgtaacctttgtgacattccctccatcttgtctttctggtaaaacaatcaaatttaaaaatcatttctaggtgcccttaccaacctctcagccagactttgtctaaagctagggaactatgaaacatcctttaagttagtaattttatggctgggagttgatactgggatttgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaaccctattattcatttagcctgcccttgacatagtttagctatgtttaacttagtaatttagctaaagttttctttctctacaaacatacttccttctggatcgttttgtttgccccagactggtacaacttcaggagcatgcctgtgtttccctataagcccctacttgttgagtttatcttagttgtctgcaggtgccttaaatgccctgagtaatctaaacttcatcagaatcctctcccacacacaggagtggatgtcaggtgatgacctcactgaattcgttaaagtcagtcctgctaacgagtggcctttggtggcacagtgatagttttgcacttgattagcattctgttagaatgcatgaggaataaagtttagaaagctgacataaaaggaaatgagataaaccttgcaaaaaacccagtcaaaccaggggagcgtgtcaatagtaggatggacctttatgtcttgtgaaaggaaatgcaatattttacatgttgtctagtttttaggggaaagcactgtttatgtctggtttttgctcaaaattgtatcaccagtaccgttcacagggccagacacatagtaggtgcttagtaaagatttgttttgttaattgcttaaagttctccagttttgctcatggcctaagccaccaaaggctgatataggtaaaggaaatggagatatctagagaaccaccccatggtggcaattcaagcattaggtgaagatttgaaaccttagatcatctctaatctttagattctgggatcaggtaaaacaatttctaggagggcttagaatttttattatttaggtttatgtatctggggccttgggtacagtctgctgaaaagtgcctattcatttcttctaataggttgggtggtggcagcagcagttgctgctactgctaataataataaaaactattatttatgtatagttaattgcatgcctggcttggtactgtacttagtgctttacacacataatctcatttaatctttgcaataactttgtgaggaagatactattttaaagtccctttccatagataaactgagaactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggctttttccaggtttgagactatttccgtgcctcatgctttagtgaggggaacacaggttttcctggcaaagcatggcagctttggggcaggaattcttgacatcctcagagagcttggtgaagctgtagtcagctgagataatttggggatgtgggcatagtaaattcatttttttaaacctgatgtcttagacagagaggtaggaagcttttcaattgaaggagggatatgatattccagaaagcttgggaaataatttgctgctatttttacaagttggcagccttgtttaataaactgatctgcactgccagctctgggaagaacacagatgtccctgtgcattgtaaggtaacgttctagattcaaactccaaatgtcctcagtctgttgtcccagatgatagaagagagaactgtagctattgatttagaattgagaagggttgcatggatcctgagttgtaatttctcttttttttttttttttttttgagatggagtctcgctctgtcacccagtctggagtgcagtggcgcgtctcggctcactgcaagctccgcctcccaggttcatgccattgtcctgcctcagcctcccgagtagctgggactacaggcgcctgccaccacgcccagctaatttttttttttttttttgtatttttagtagagacggagtttcaccgtcttagccaggatggtctcgatctcctgacctcatgattcgcccacctcagcctcccaaagtgctgggattacaggcatgagccaccacgcctggccctgagttgtaatttctatcagtatgtctatgctattgcccctagacacttggcatttaagaatttaccattcatagtttcagatatccacatcagacctcatacgctcatgatatatggtaaatattattttgctgaggtatggatttgagtcataatgggttgcaagcttgctgtgtgagagtaggtcactcagctaataaatcaatctatcccactctatagcagcagaatctcataactatattagtgttccttctgtgttatggagaaaatgcgtatgctataaggcagcattccccagagcgtggtcaagggaacattagttaatcattgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtatacgttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcatatttatcttgttacttagcccttataataaccatataaggcagacaccattattacttctattttacagatgagtgatggggaaagagcttttggaagtttgagttaattccttatggtcatgcagctaagtaagtgtctgagactacagaatctgaattatttcccactatgcagtgttttgtctggtttgtttccctatctgtcaccctcacgtgacatataatagacctcaataaaatagttgttaagtaagggaatgactgaatgactggtcatagctattctctaaatgtttcttgagtgaatttatttatatagtcagaggaaaatgaataatggtttctttttctctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactagtttgtcttgttcttttcatctggagaaagccccatattctgattatgaaattgcatccgattttcaaagattgggtaattgagaggaaattgatccaattgaaagtgcatcacaaatgactccactagttattagagccactttatctgtgggggcacccagcagcaggagatctgtctttgctgtcagtgggggacttgctgaggcaataacagtggctcaggcctttggcacacagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctcaaaatggaagtgtgatctgagtctttttcctttttcccctttgatgtgaatattttaggctgtgcttagtacagtcgatgtttaattatctgctgtgttgactaaattgcagactagggccccaagaaactaatttgttcaattacagcagttttttgggttttttttttttttttgctttgttttttaaagcagcagtacccttgtccaaataaagtcttatatggaagtctatcatgtaaaatagatcaaagagcagctgctctggttgaagcaggtttgtgccgctgaagaatatgctgtttcctccctttaccttacctcctgtgctaccattgcaaaacttgtgaatctacagaatacttttctgaaaaccactgaactacagcattgcttaccttatagttctgtcttattagtcatgtggccttgggcaagtcatttaactcttcctcttctggaaaataacaaaaatgatccctgcctcctagaagggtatgagataacatgtgaaaataacctggtttcattcctggaatattccataaatgatggctgttactcttttatctagttgctcaaaagagcacctgatggtgggaagtggtccaaccatgctaaacagttcctttcttcttgcttaacaggtttctatttggtgattaaaacctttctcaggcatttctttcccctcacaagtctccaaatatatcaagttcatctcttcctttctactgtctatttcacattcctattatataaatcactgtgttgcaattatctgtccatatatttgagctttattgagggctaactaatctagctaccagcatgtaacatggtgcctagtatagaatatgttatcagttatttaattggttcaggtatttacctgacttaatgggactccagtaacccgagtcttcctagtgtagcccccttagattagataaaaaaggatactcagacaagcccttttataaggtgtttaaaagctagtggcaaacaattgacttagaggttggttaagcccctcctccctttatcattctgagtggttacatagaatttaagattttggagcaatgattcattcaatatttattaactacctactgtgggccagtgtacactccggacttgagtctgtagaggggcactcttattccaatcagtagaataaacgtggcgtgagctttacagtgttcctctgggtaaggcaagtaatgcttaagtagttgtacttttaatctagtgctaattaatggcctcttaaaagtgcagtgttgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgattcgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccatgttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggagtggggaggggtagcattgggagatatacctaatgctagatgacgagttagtgggtgcagcgcaccagcatggcacatgtatacgtatgtaactaacctgcacaatgtgcacatgtaccctaaaacttaaagtataataataaaaaaaaaaaaagtgcagtgttactctactctgtaggagggaagtggaagggagaacctagtatgagactcaggtctccaccctgcacttgactaggatgctgatttgcactcaggacatgcagcccttcaaggcatctcaaattacagacatgaaacaacagatgcctggatgaattttacaagcagggcaacagtgaggaagaaggctgtgtagcaaaatatacacttagactccagacctatggctttatcttgtcaatatcattaatattcacgggacccaagctaaggctgaagttagtgagccagctctgggtctggcaatgtactctagtgagaagatcaccggccttgaagtcaggcttgtgtctgaatcacagctctgcattttaactagctgtgtgacctcaggtgatcaccatacctctgagcctcaatttccctatctgttaatttaaataagggtgttggtatgtcaccaaaatcccttctagctctaagattttaattaatttgttaaccaatggaattgttgagttccccccaatgtttttgcataatctttgttataactgtgttttgtttacattagaatagtagaacaacaacatcaacaaaaaacccaaatcatccccaacttgatataattgcttctctaccccagctgttgtgactttgtgtcacttagctgttgtcaccctgctgagctagagttttccttggtaaaagaaaatgaatgacagtttatgttttaaagggctgttgtgagaattaaaatatataaatgggatagtatatgtaaaagtacctaattcagaaaatgtgtgacttccattatagggggcaaaagcatccttcccttcatggtgagttgttgatacacattcaagtgaaagccagtggagattttcagacctgtattggtgatgcaatagcatgttcagcacttcttggcctcttaattgaaaagcctattggaggaagagtgggattgctggaggggcagaagcaatactcattcacagcaatgtatcccattaggaaagctgtaaataaatcctaaagtctaatcatttgattaaagtaattaagatggcatcttgactcttttgaggggtaaatagagccaagatttttttaaagattttatatatatatgcactaatatgtagtacatacatctaagtatatacacacacgcacaggtagagatgaaattttttttaaaaccttagaaacatgcatgtttagctatttctttagatggctagcttcaaagaattttttctctaggtcaaaatttattaactcaaataattataaaaataaaagtaagccacaaatatccctgttaagtggttaaagcttgagctttgtaagcagggagtcctgagtttagtcctgtttccctcaattattagctctatgaccattaagtcacttaacctctcagtctgttttctcactagtaatgactgtttcacattttattgcagtattgtgaagagatgatggatatataaatgccatttagcagaataaaaagcatttttgaaattacagtaaaccaaatatatctgaaattacctcatttttgtgatataaagatgatatgaaactggtaagggaaagtctaacccctgcaaccgcaaaggaaaattatttactaactcactgaaatcttgattgaaaccatgaagagtttgtgtgaatgtatataagtcaaatgcatgttttccctatacagataaaaccaggattttcttgtggtgatttacccagtttacctggttataactataatggcattgcatattgtgaaagaatatcaaaacctgagattccatttattcactcacttattaaacatatataagacatctaccctttattattattagcaatacttaatatgagtaatgaatgcaaagaaaatcagtcatgaattttgtagtcaagtagcttgtggtctggctgcagagataaggtatgtaaacaaataataaaaaatacaagagagtaagataaatggtaacaggatagaaatggagtgccaagtgtttgagtaaagactgctgagaagatctggttgctgaagggccttaaaagtaaagggaatatcgtgaacaaaggtacaagattaggatgaagagtgagaagttggtgccagaagttaaaaccaccccagaatgaggggacattaaagaaattcaaaggtctaaagtggttaagtaataattcaaatggttctttttttttctgccctagtttatatgacttactgccaacagtacccatggctcagtgaggcttcatacttatagaggtggtagggtatgaatcagaatctccttagagtcctgagggtggagggcaaaggcatagtttgaaaatgcataccctcttcggtattctaatatctctcctgatggggaatcactgattgacattgtctcagaaatacattttctgtcctttaaaaattctgaaataatatcaaatttttctcccctcagaagcctacgccaaataagtgctgtaatcttagtacaactttgtagtacagtcagactcatttgttgatgtctgactggctgagtttttaaaacctattattcccccttccgccccatatctggacatgccagtaagaaagctcaaatgcttccacctttgtgcctggtggaagttcaaaccacctaagaatcctcactgcagccctacctccaagccactaggaaaagccaggctcctctactttccctgctcaagccatttctggacctgcttgagaactcgctgctctctgtaaaagcctcgtgtgagtgataaaccttttcatatctatttggtcctaatgtaacatcagtcctaacacctaaaccaagttttgggtaaggggttcaacctctcctctgtgggatgactaaacactttatgcaacaagcagagggtctaggagatgaccactaccactgcagggctctcctcttgctttagtttgctaactgactcttgctggctagaatttttttttttttttttttttttttgtcactgctggcaagctcatgctttgtgctgtgctgctttgtactgcgttcactgagccttaccaagcttctgttatagatgtgctcagctaagttggaatttttgataattggcatttaagaacaagaataaagtggcatttaagaacaagattaaagtggccctgggtcatgtgtcttggtcgagacttacctgtgtctctgaattgtgtttctggatcccagtgtcagctgtgactgtcacgaggctcagaggaatgactcttaccctgtgacttttggttgtttatctcaaccaggtgttgccctcattgtatggcgtactcaaaagaaacagtcataccctatgcaatatgcaggctggttggtagtcactcatggacgaagaccatgttgaatgctatggtgcacactcccaaaagcagatggtttactaggactttacaaaatgcctttcttcctacttctgcctatgccctatgccactatgccccctgaccaaaaaaaaaaaaaaaaaaaaaaaaaaattcctgatcctaagggttatagggaaaagcatccatgctatagccaaggagttctttcaaagccaacttaagcactgggtcctcaaaccctataaagcaactgttggcacgggagagaacctaatcctgattatatgtatttgcaactctggaggaagaatcttacacatatgagcaggatcgagaggaccttccctcctccccaacccctccccacaccaccaccaaatgatatacggtagccaccaaaaggaaaataaaataaacttggatactgggggaaagaaacaaaaaactaaaacagaggttcacaatttgacccaattggaaatccaaaattaaagaatttttgcaacaacaacaaaacaagataaaaggttactatttggcttttgtacctctacaacctaggttccgaattaacttttaacatttgctgaaatgcaccagttgtcaacccttcatagccttaatattgggcttcaaattatacctggaattcccctaaatttaaacaaagtacccctataatcttagggtagttaactgaggatattttaggacatgttaggaagacaaatagatatgcctcatcttaatcagaactattgccctgcctaaattcccccatagccatagcacccattaacttaaaatatcccatagtgggcatggatgctctaacccaatgagtaataaattaaaattgaattaagtctttggcacttacaaatcagcttgccaaaatgggacggcatggaccttcccctcctccgttagttaaaatagttaatatggcccaatttaaattaaaacagagtctttgaggtttgaaacccatataccagacctatttggagaagagtgactatccccactgcttcaccattaatggcccaatgtagcctgttcagaaacctagaaagaatgaatggcatctcacagtagattattgccatgttaatgctgaagttctatccaataaggctcccatatcaaatattatcaaaattactaactttaatcaacaactggtaaatacttttaattcatagatttggctaatattttagcagcgactcagccacaatttgccttcaccatcaaagggatgcagtatccttttactcagctactcatgggataacaacagccaggtcttcacacagcctgcagacaagatcttgaccacatttaactttcttcaggagcacagtaaacactgatcatactgatcacatcatcctccaagaaggttcatttggcacactcactgaggacacatatagtcataatcataaaagagctcacgaaaaagggatggaccactaccccacacaaattaccaagtccttccaccttggataaattcctgaaagctatttagctgagggccattctatccctgacacttgccagaaacagcattcgcaatttttttaaaagcccaatatgttttagtctattttgagttctggagacagcatatttctcatttacaaattttacttaaacccgtttatactattacttaagctcacttatgaattataatacaggcactgcaattagtgacccctgagagtcctttacttaaaggctttagcaacctcctcccatgattcctgaagtctctggcccacacttgatggccctaagttgcccacaggcatcttgtgccataaactgtcccttcagccccatgctatatgccattagagtgcaattgctggctgcatattggactctcctggaaacaggctggttgtcaccggccctcagcctgtgactctccataccagctgcccattatcccttgggtcttgaaatcacaccctaaaagttcaacatagccactgaggtttccttgctgtagcatagagccaaacctggcatatttcacctataggaaaaagtctcccaccaccaccctcagccccttgctaaataccatggtgctggtaaaagtcatcccccttcccagaccctttggatatctgtggaagcccttgcaatcaacagagtgaagagtaaagggagtttctccactttatagatggtatcactaccattgtatgtgatggagcttgctggaaagttcctgatttttagcccataactgggacatccctgataatgaaacaggacccaagtcagcacaactggccaaactttatgcggtccttttagcactgaataccctgaccaacatctgcacagttctatagactgttgaaccactgccagtgatttgctcatctgctccagccaatagcagcaaaaacagttttctatccaaggttgcctctttgggttaaataactctgtgactctcttgcctcatatatatatacttatactcaaagtataagtcaaggtcatttctactcacaataaatccacaataaaaggcctcattaacactttaaccccttcagtagtctagaaattattgatagtgactaaggcattcatttcacatctcaaaatacataatattgggctcttgtacaaggcatttaatggaactttcacctcccttaccagcctcaggctgcaggcctcatagaaagccataatggtttattttacctaaacaagttcaagttcaattaaatgaaacatgccacatttcagtcatcagtcaaatatcagggatgaatcgtaataaagattctgactccatttttggtacttgactgctaacaactttcaaattcttctacttactccctcttcttcagcttcacatctgggaaaactgatagggaagcctaggtaggcctacctttggtgccagagggaagctcaatccatgcaagccccagataatatatgagaacctccccaaccttaccctacacccctcacctcccaatccaagccagtctcctttccctgctttctcaaaccatgtttggacctgtttggaagctccctctgctctccctagaaagcttcattatgtgagtgatacatcttttcatatcttcttggtgtgtgtgtgtggtatcatcagcctcaacatctgaagcaaatgttgggtgggggtacatcccactacttctgagtgacaacagatgtttagagttaaatattgaaagaaatttcatattacgataaatgacaatttcagaccaggtgcagtgagctcacgcctgtaatcacagcattttgggaggccaaggaggggggaatcacctgaggtcgggggtttgagaccagcctgaccaacatggagaaaccctgtctctactaaaaatacaaaattagcaaggcatggtggcgcatgcctgtaatcccagctactcggggaagtctgagggaggagaatcactcgagcccaggaggtggaggttgcggtgagctgagatcacaccattgcactccagcctgggcaacaagagtgaaactccgtctcaaaaaaaaaaaaaaaaaaaaaaaagaagagaaaaaagaaagaaaattttgtaagttctgagcaaccacatgaataaagccatgtgttttgtgaaatgacgtttaatatttaaacttaaaactagtaataaatctctaaatctctcagaccccaagatatgaaacttgtttgacacatttaatgattctgtaaaagtgtaagaaatgaagttaaatgaagaatgtcatggcctgaaaggatggaaaggcattagacatgcatattaccttgcctgatccaagactcagggactggatatagaagaatgaaacttccattaattgatacactggaagaaaggccacatacaaataggcaaatataccgtagaccctgcatagaaggctaattagctaaatgtaaggtgcaaatgctcaagcaacaaccctgaaagtgtgtattcctcctttctgctctggcgactatgcctatttattctcctcaatgaaatgggcatattaactccagcctatttaatatgtactacaactactcttcaatgccccataacattttacacaagtaaaagctgcctaaaaatgagcagcatagtcagcctctctgaatgaaataaaatgtctctaaataaaatgtcagaaataatacaaggtatggcagcaggaaagtagcttaagaaaacaaattgcaaaagggaacatttatttttcttctggacgataccatctttttctatgacttcaatcatgtatgcagctacataccaaactgtatttttcatgtcttaccttctttttgatcaccagattggtgtatacccagctgcccattttatattgccagttgtatataccttaggaatcttagactcagtatattcaaaactgaacttggctctaccatacctgctgctccttttttatttcacctaaggaactccagcagtcactcaggcccttaagtcagaaagcttggcaccatgtctaatcattttcctcacctttcaccttctactgtcccatcatgaagttctcatcattctagccacttaatatttttcacatacattaattttttttctgaatcctcatggctgctaaattttaagctattatttttctccttgaaacactactacaactccctaactgatcctcctaactctaatctagcatctcacatatacttcctcccatcccaagtcaagccctatcccacactagccagagtcaaattctaaaatgcaaatgctaatgataatatacaaaacctttaaatgacctttaagtgctcctagcaaaggtacaactttcttaacatggtctatacatcccagtgggatttgattcctgtccatctatctttctaggtttatcttaccaccacttccatcccctctagagctttgctccatccacaatttcttttttcttatctcagggacatttttgtacatgcttttcttgcatcttggaacatttaccttctccatacccacctgtgttggcctaaatcttaccttcttcaagtgttctggaatgcccttttggatccaccttaactgttttgagccaggtgttcatgccacactttatatttctccctctagcatttacatatttcatggtgatttttctcattaaatatctttttccaagactaaaatgagctctctgaaggcaaggcaatatttaatttactgctgcatccatagcatctagcacagtacctgaaacatagtaggcactataattgttgctgaataaaaccagaggtcagcttagctcatatgttgacatatgtgagcactctgggtcacaattagcatcagctggttatgccacctcctgcttctcctagtacctgcatccctgaatcattaagtctagctgcaatagaaagtggggtatggttgaaaggtgggaggagtggttccctctgatttgcttttccttagagaatcttctcaactgtaaaataattgaaagttgcgttcctttctagactcaacccgaactttgttttggtgcaatgtcaccattggaagagaaggctcaaaaatatacctttcattgtgtgttatatgaaatatatctcaataaagctgttacgaacgtaaaaatgtgaccttgagcaagtgagtttccacgttaggaaatggagataataaatgcccagcatacctcctggcatgtaatgaattctcagtacatgtcatgtggacttgggagtcagacagtcctgagatggaatcctgtctctgcctattagcagccatgtgacctttggacacatggccttttgaattgccactcaacacacttccttggatgggggaagaaagagagagtactaatcctgtttgagtcctaatattattaactaatggttctctttgggcaattatttttcttctccatggcactccatttccaccatctatatttgttaaattaaggatctttctagttgtaaacttcaatgattctggtgccccataccccggagacttattgaatcaagatctccaaaaggagccttctttctgggcatctgtggagtaggagggaacagcaaggaagaccctaaagacaaaggaccctaaagaggaaagcctggggcctagggctggtacatcagatgaagacaactaaggccagctcctacccaatgtatcaatggtgaagttgatctctaaggcccgtctcagagctggcactctgactcagagccaaggggttgctaggaaacaagggtctagagcctgctggtcagcatcatgcaggcttacatcctgccgatcaatctccctcttttttcgctcttcctgactaagtacttctaattgttgcagggagaagagaaatgccacacaaagagaactttgggagtgcccactttggctaagtaatagtaaaatgtaaatggtaagagaatcggagcatgaaaagacagaagaaagagaaggcatgagagaataccatttgccaactctgtgcctttgggttgtatatcttacccctcactcccaaatctcagtttacttccataaagataccaattttaggaagttgtagggattaaatgaaattgtgcatgtgaaatgcccagcatatctcctggcatgtagtgaattctcagtacatggcataaggacttggaagtcagacagccctaggatggaatcctggctctaccttttattagccatgtaaccttgagcagataagttttcacattaggaagatggaaataataatttggacctcacagggttgttatgaagacaatatgagatcatgtgattaactaactcataataggaactcaacacatgtaaatcattgttgccctttcctctgtcaccttctcttccaacacacatatacgcacatatatacattcttctagaacaatataagcttggtgttcagctgtgcaaacatgctcccatgtgccctactgctgagctccaggctgtgctatctgacattctcaccttctattcccacctccaggtttaggaaaagctcaaattcaaaagctgacagattagccagggagaaacagccatgacataggaagtctggcaggaagaagacatatatcttaggctgctgtagtcaggaccagaaaaggctgtatcattatgccttttgcttgagaaaactaacagtaataataatcattattggcttaattatgtctcatgataataatgaatgatgatcataatagcatttcctcagcatttgttatatgccaggtgcagcagtaatcactttacaaacatcaattcatttaaatctcataacaatactgcaagataagcataattatacccatgttaaagataagagaattgagtcccaggaacctaaaagacctgacctaagtcacacatctagagaatggaacagatgacacatagcttcttatgtatgttgccatttgttgaaacttacacctgtcgggaggagaatgcatcaatgactgacttgtgctgagttcctgctatgagccacgtaatcacatgatctcacatcatctgcataagaatcatgtgaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaagaatcatgtgagatctaaatgtttttccagctattcccctggtatctcccaaagtggccagttgttttcacttaatttaaggcattggagattcagtcttttctatttgtgacagttctcagctgtggacagaggcaatggaagtgtctctaactacttgggagactgaggcccagtgacattcaaaggtctaacaaagaagccaatagcattccctaggagcactgaggggatgcaggtactatattgctcctaactggtccaagagacttcgccattcctaaaggtgccaggccttcctacaaatctagctttgcattgttgtctccttgcgtggagtctccttcctccccaccttcccagttggcaaatgcctactcacccttaggttcctgtttagacatcttttcctccaggaagacttcccagtccaccctcagtaggttaggggcccatctctcagccttgttccctccactccccaccctccatacacatgcacactttatgctttcctctatcacagcatttatcaaattataaagcatttattaaaaaaatctgttcacctattagtctttcccatttgactgtgggatctttgagagcagggactgtgtctcacttgccttagcctccttagcacctcatattaggggctcaaggaactactgtggaatgatagagcggtgagaaaggataaaggaaagaaatgagaggcagacagggaagaacagggccccctggggtgtggtatctgaaaggactgtctgtgagcaaggctcctctcaggttggtaggttagacctgctgataatgaccaagggaaggcaaaaacttcaatgtatgtatctgtattccctccaggccattttgttctcattaaggggctgaaggcagagagatagcaaaagctccacattcatctccagggaaattccacattcttagtgccagactgctgagagaaaagggtcctatctaacaatcctgctccctcaggccctgcatctctgtctgggactgtgactgtgacaggggaatgagtatgattttgcacctgtttgaatcagagtaactagtttacaacagtatcaatctcttgtcacttcccctaggaagacggagagtggggatggtctccagtgctttaggtaatgatgcacacacatataccccaaataatataatgagcagtctgccaatcaaagactctgccatttataagtacatgggaggctttggcaacaggtagtctttgaatttgttctaagttttctggagagggaaggccaaaccatgtttctacctggttattaaatttctcccttcaccactgcaatttctaattgattgcataaagctgacctcatctttcccatctgtagaatgggaatggctaaccaagataagaatggaaaacaccttacacaagtcactatttcttactgtcacacccatgacagacattgctaagtaatcactgcattcttttccactgagcagagtcctggcccagaacctcaatgcagtattccaggcagttgattgcaatgggcacataaagaaaaactcaggcctgactatgtgattgctaatgcctcttcccactctgactttgtaaggtttgactttactttataatgcagccctgaagctaagattcagaagcagattatgctgggagatactggtggtaaagagaatattttcacccctgctcaagctgaaggtctaaattccaagtcttagctttcctaatttcttttacctgtggataagagaaacaacaggagagcaaatgtttacctttgggtttgataccaacatctaaagagttctctgaggctgctgtggtatgactgaaccaacaccaactccgtgattaatcagcctgggttcaaatccctgctttgccaaattccctggtgtgaatcctgacaagtcactttccccttctgagcctcagtttcctcaagcatgaaatgcagataacaatgcttgacttacagactttttgtgaggagtaaactggatgaaataatgtatgtgaaagtgctttgtgtgatgcactgcactgagcacatacagaggattattattcttggtatgcaccaataggaagaagactagggtgttccgttccagatggactcaatctaaaccggggaacaaatgcttttttttggtaatttcatcttgtggaaacggcagtctcatgggcctatttgtgtttaatgaaccacatcctgtatcgtctttttgcatggttctgaggagaaatacgttggctctgtcttctggcgtgctgtagactagtgagtgtcaagctcatatttaacctcctccagtctctctgccttctgcaagaaaacgcttccctagagctagattgatcctacaaataactgcacagaagctaaggcacaaagggagaggaaagggatagttagccaactctcaccaccatgctgggaccctaccatagacaaatgcagccaggctgggatttttcacctaggataaaattaaggagtttagattcagaggtgactgccctggggtcaagcagctaggaatcagaaaagccaggtttatctgagttcaaagtcagtgctttcaaattttcaacaaattgcttttaatacatcagtagtcttcatcctttctggagtcagagaaccctttgagactgcaagaaagctatggagactttcatcccaaataaaacacaaatgcagatgaacaacactttgcctataccactaaggcatttatgaccctcccaggctcactcaatctcactcactcatttatttcaataaacattattgaatgctatcaatatgccaggcactggctaggtattagccaagcaggcatggtccctgccctcacagagcttatagtgcagcaagagagaaagatgtaaactaataaatgtgaacttacaaacaggttatgtgtagcaaaggaacatcattctaagaaaataggaatgtagcaaaggatcctgacatagcctgaggcttcttgaaaggttttctgagaaagtgacatttgagttgggtgatatgaagtgatctcagcaaaaatgggaaaaaaaaatcagcagaaggccaagtgacaaaaggattgcagcttgttctaggacttgaaggaaggtcagtatgacaaaacggcagaaagcacggagacacacagggctgaagaggttggctgaggacagatcagaactgttagagccctgaggccatgggaaggaatttgcaaattatcctcacggcagtgacaaggcacctagaagttttaatccaaggaataacatgatgggatctctattttagaaacatcctataatggttaatttcatgcgttaacttggctgggttatcaaactatttggtcaaatagtattctggttatgtatgtgaggatgattttggagagattaacatttgaattggtagactgactaagcagattgtcctccttaatgtgagtggacttaaaccagtaagttgaaggccccaatagaaccaaaaggttgaccctcccacctgaatgtcttgagctaggacattggttttttcctgcctctggactccaatggaaacatcttcttttgttggatctcaagcctgccagccttcggactggaactatagcattggctctcccacttctcagggctttggattcacactggaattacaccatctgctctcctaggtctccagcttgctgactgcagatgttggaacttctcagcctcaataattatgttagacaatttattataataaatctatatcatctatatctatatttacatatctatacctgtatctgtacatatatatatatatatctgcctataagtctctcgctacatatccatcctgttggttctgtttctctggttttgttatcctggctaatacacatcctcagggctgccgtgtggttaggattcagggaggcagggtagatgcaggctgaccaggcaagagaacaaagctggaatccagacaagctatgatggtgacttggaatagggtggcaacagtgaggaagaaaaaagtgggcaaatttaagagttatttgagaattaaaattgacagaacttgaaatggtttggaaatgggtggctgaaatcagcagaagaccttctcagaaactaaggtacaaagggagagggaagggatagttagccaactcccaccaccacagacaaatgcagccaggctgagatttttcaccttggataaaattaaggagttaagattcagaggtgactgtcctgggatcaagcaatttgaagtcagtgctctcagatcttgagagagggtgttgagaaggattcctaggtttctggttctgcttctaaacagataatggtgcttctcactagaacactagaaaagtattaggttgtgtggagtggagtttgggcaggcaagagaactagaatgatagcaaatatcagaggaaagcttgatgttggaggtataaagtagaactcatcagtgtggggattacaacagagatcatgaccatagaaacaagtctagaaagaggggtccataagacaggctcctgtgaaacttcacttactaatgttgcagaagaggatgaacctgcagaggagacagagatgcaacagtccagaggggaagtagaaaatcatgaagatctagtatcaccgaaacaaacacagaaagtgcctcacacaggaagcagacaactttgtcaaagcctactgaaaggtcaagcaagatggaacccgaaaactgtccgcaggatattgaatcactgaggaagtaaaccaagaccttgcaggtctcagaccctaagaacaactccgttcatatcttgttgccatcttaaaagcaagttccctcgggaaactgaaggctctggagaattatccagctctcatcagccccttggccacatctgtcctcaaagaaaaggcgacagttgaataatcattcccttctcctcctccacccacaacccctgagatgccttttaaacagccaaaaactcctttaaaaagtagtctgggaatgtttcagctgacattcaaaagcacattgtaattcaaatggaagtgcagaaatgcaatcccttggacagtctaggaaaatgataatagagataagacaccttttaaaagtggcgacatgtatttatctgtggggacatttctataccatggactctcccaatctaaactcaggagcagtgcaaacttcacatagagaatgtccttccacaggggtcacctaggcagtacacttggaaaagacatgttaattgcatagcattctttcacttctagcctctctttatctcgccatttctctttgtggattttggtgtgcctttgtctatctctctttgtttttctgtctcctcctcccctcccctcttttctctctctctctctctctgcctttcttttcctctctttcttgctctagctctctgtccctccctctctctcacacacacacacagaatgaacaattctttcacatacacacatctgtcaccttccatagtcagtttctctataaaaaagaagcaattaaaaattcaaaaaacttattatatttctaattcctgcatctatcactatcctccctaagtagagaatgacaggggatgataaaagttacagattccttttgatatctccccagtccagttccacagctctttcccttcactggctccaagcctgtagctaaactcactgaggcccctcccaatcccaggacaatctacctctgcccttgatcctgggtcacaacgatgacaagggatgagagcaaattagcaagccccacccctgcccacacacatgtgtgccttcacgcacatacatacacacaaacatacacacctgggaacacagtaatcgaagtggatgtggcagccttgggtggagggcatgggttggatcaagataattaggccctcaactcagagctggatgggtccatccattgctctattttcttattccatctatacaatgactttgcattttgcatatggaaaaactgatcttaaagaatgaatcactttgctcaagatcacacatctgggaagaggtagagctgggatttgaattgagatccatctgattgtaaaacctgtgctttatctccaaatgagaaagtctttatccaaggtagccacaggaagggtgactttatacagtgaaccctcatcatgatataaagctcatgtatcatgatcacagctagggagaatgcgtgaatatcaagtcaaagggtgaaatggagccccagtgggaagaaggtagttttttcaaaatacagggatatcaagagcacagaagcatgtaatgaaagtattatgctagaggaagagactcagaagttcacacactgcttgggggaatggcacgggagcagaggtgatggctaaagaaacctgacaggctaaacagcttccatgctaatcatgtctggaacctagagcttccagggatgactttggctgctctagttgtttcctaaggcccagttcttcctgcattagattctaccttattgacctgttcggtgttccagtcccctacggactactggaaagctcagaattcccacctggtgatataaaactctgccttcctgcctggagatcttaccagtggttattggcatgcccagtgccccctctggaatcaacatcaaaaactaggtctgttattctagcttttatttttgccctattacagggaagaaaatacagaggatctagaccactatacttcctttctgtgtctagaatagacattaccaactgatcatctcaatgatcccaataacttacacacagtgttctagacaagccattccctagttgatcagaattggcacatgaaagctagagagcataatatgatagtgactgggtattccaaccagcctggaaatgttggcctcctccctcttcccagctgtctaccagtggatttttaaaagtctgtaacaaaaatgatgaaatattgggatactaaggcatgctggtaatgaacaacgtaggaacagagcctatatcttctttatttggtgccacaacatctgacgcacacacaaaaaaaaatacagagaaaaagcagttgggaaatgttcagacaatcaatgaataactatgactttattttcccacacaatgtacctttagaaacacttaggggaatgagagtaaagtaaactcctcatgggaaatattttaatcaggcacattcaccccatctcccttggctttccagtaatttccagtggtttccccagatcataaaagtggccagggtcccatcattatgaaacctgggaaggctagggcatttgtttctaatatccagggacaccagagctagggtgaaggaagaactgggctgaagtttggattcaaataccatcttcttggccttttgcctctgtaagttaaggtttccctcctgtaatgggggaagtgagtacccttgcctcctttgctttctggggtagatgggaagatcacaggaaggccatctggaaactgtagagggctgtacaaatgctcatggttgttatccatgccctatttggtctattttccccaacctactctaccgagtttgaccctccactcctcccttcactaagagttaaaatgacacttacaggattgtctttatctagtgacatctgtaattcacagataaaaatgagggtagaggctgggcgctgtggcttacgcctgtaatctcagcactttgggaggctgagatgggcggatcatgaggtcaggagattgagactatcctggctaacacagtgaaaccccatctctactaaaaatagaaaaaattagccgggcatggtggcgggcgcctgtagtcccagctactccggggactgaggcaggagaatggcgtgaacccggaaagcagagctttcagtgagcagagatcgtgccactgagctccagcctgggtgacagactgagactccgtctcaaaaaaaaaaaatgagggttgacctcacacattagcaaggtatggagctgggactagaatcctcagccaatgcccacaatttttactttatttcaagctactgttttctatgtacctactatgtaccagacattttacctacatcatctcattttattctcccaaaagccatgcaagagaattactatccctcatttaacacatgaggaaactgagacttagaagttcctttacctgaggttacctgccaggtgtgtagaaagaggagtaaagacatgaaacaccctccatcccacttcagcactgcactatctctcctcctctcacaagttctgcccaccgagttatcagcctccaagcccagattcatcctggcctggtttccaacgtttagcagatggcagtgacacataactcatggccggggagaaaaggggatactagctatctttaagtccaaaggcttctttcaactctacagatgcatatccccagcttctcatctcccattccctagcatcactcccaaatataaaaaataaaaccggagtatttgatctaccatctaggtggtcacagcaggtgaagatggaggggaagaaacacacacagaatggttaagctgacctcaatgcatcctctgtccttttcttgggagcaagtatggacgatggaagcaagaaaagtgcctttgcagactagaagcccaggaaggaaaacaccaagtttaccccacaagtttgcggcaaagccaggtcttgagggggacccctccagctgttgtttcagcactctttcttcccctctcccatcttacttgtaacagattccatgatccaccatacaaggaatgggattttctggaatgagaaagtcaagtctaaagtctgaagacagctaaggatggagaaggggtgggatttagaatcagagtagtgtcccaagccccaaacgtggtatgaagcaaattagttatgtagccacagtgagtgaaggtttttataaacataacctaatagtattacttcaaagtcctgaagcttattgccctgcttaatgatgtgtcacattatttgtagggtagcacaatgagacttctattgatttaatgcacttccttaaagactgtcattgacacagccataaaacggagctattcccagacaactcaattatatccactgtgcccataaaccaccccgtgccccacacagttgcacacaggaagcagaaagggctgagagcacgactggggatgcaaagcccccagggacaaaagggaagggatctagagattgggaagcaggtggactagggttttatccagttgggaatgtgcagctgcataaaaagcactagacaggaggtgtagagcaccccacttggtcttggccctgccaagcaaagctgcgtgaaagctcccttcttctcccctatagacttagtttcctcgactgcaaaactggagtgctatgctcaatgagatccttcagatccctcctggctcccacattttgtggttttttgttatgattgcttttgttcttggagatagggtggctgagctgtatgaaaagatgcaagcatgtttttaacattgctcttcaccctttccatcaattgagagactttcttttacaaatagttgataataatagtattaactatatcaagaagcatttcagtatagttgaaagagggaaagaacatgggcttttgcagccagccagccttgggttccaatcctgaccctgctacttattagctgtgtgtctatgagtacttgatgtggcatatctgagactcattttctcatgtgtaaaatgggagtatgaatacactgacctattaaaacacatatatacacatgtgcgatattctaacttcctcaaaatgctattacataaaccacttatctttaatgtgagaagcagacaagaatagctacttacgtacccatttcacaggaagagaaaattgaggtggaaaaggaataaccttcacaaggtgagtgggcagagactggtctccagcacctggtctgaggaattccaattctgataatagctgagagtcagaggaaaatgaaatctgctggcccttcctgaggataaaagcctcaccacaggacagaatggaaaccgtctgcttggttatgaggtgattgtttttccaaaggaattgagttcttcttgggagagaagaacccaagatcttcttgggttctcccaagaagcctggagagaagaaagtgtcaagaagacaccacttgctgacccccaacctgatctctggcagttgtttcaaagagaggatgtgggaagcaaagtacctgcaagagaaggcaagggttctggagtctagaacactaacttgaggcctcagaaaatgcctgacttgagagaatcctgcaaaatcattatacgatccctcactctgcccatggtgaaactgaagctcagagagaggcagggacttgcccatggtcacacagcttagacgtggcagagccaggatttagatccaaggcagctcagttgtctccccagaccccttgcctctatagcctgcctggccacctcctacagtaggcactccgggcttacctttctgatactggagccacagctgctgctggaccttcttgctgggaaagtggatgatgcaggtgagctctgagccatagagggcctctgcgatgtagtgggagccatagtgctggatgaaggacagcagctcctcccgactgctctccttggtcaggatcttgagaacattagtgaagcctggacaagagaggagcatgtggaggtggtcagatgtgagaggctggcggctagcaaattatacggtggcaggagttcttcccaacctgtattttgtgccttacccctcagcacagtggcagcttggtggctgcactagtccaaacatatacataattccctcacttaaatagcaatgaatgccctctctgaggggtacatcagacacggtgaccaagagggaatctgcaggagaagaaggcctaaactcagcaacgtagaccatgggaacttaaaaaagataaatcaagaagtcaaagctgatatccactcactgagcaaccaatgtgtactgggaaaactgttagatgtttcaccctctttatgtaacttaaccttagccacaatcatatataatttgacaacaacaacacccattgtataatgagcaagtcaaagctgagagactaaaattgagttatcttgaacttccaggtagagaaagaagctggactcaaacccacttatgttctcactgcacactgcatgcattttccaccacaccaaacaaaccagggcttgaactgcccatggctggaatcctaaggctgcatttgcccagagtcagcatgtattctgagtccatgaatctgattcctggtttagcttcctgtagcattgcttttctttatatctctgctgttccctctctttaacagtggtatgttctctctccctagatttccacagagccttcttgctgctctatttcttagtcctaggctaagtcctcagcacttaacatggggcctgcacagcagtcactcagtaaaaactgctccctctttctctccttcctcaaacaggcacatgagcaagctattcttccagggacattcctgagctcctccctgctactggacaaagcctagtgaccttctttagaaattcaaggttccaagctcatctctaatgagccacccacactaagttttagctccagccaaattagttttattatttatcctgaatgtgacctgaaatttctatcattctatctttccttgcattctcactacactcaacacacacacacacacacacacacacacacacacacacacacctgaaatggcctccctatgtcctccctaagtcacacctatgcttcaaggcccctggaagtcacctcttctccaagaagcctttcacatcattatggacaggagtgcctactgtctgcactttcaacatgcaccaccttaaagtcggaagctctaccttatttgtctctatatccgcacatgcatcctccctgcacacccaccccaactgggtacatggcccagttcctgggacacagcaaacacaccaaccacaattattacaagaacagccaacactgtgccacatcaaagtaaaatgtaaaagaacaagcttctctccagcattaaaagtgagctccaatttgccaacatttgattgacaaaagggttttccgggagcatcattattgattaattaaagcagatgcacctttgtacttctaacaggaacatcatagtcttattcacaaatgcagtgtggggtgtggggggcagaaaacaaaaatagggggctcaaagaatgggtgtttgatgagaacaacccctctccatcaacctgttaagtaatacaactgggtaattaatacagtagtgttaataacgagatggtttctgttaagtaataaaaaacaataccacagagatgccctgagggtcttatccaggcagacaaaactgcaatcaaatccttgattcattcattccctgctctgccacttactagctgtgtgaccttgggcaagttatttaacctccctaaccctcagtatacttatctgaagaaaaatgggataaataatgtcttcctcacagtactgttctgtcataagaaatgaactattataaaatgcttaacagatgtcagcaataattactatttctacttcccagagggtgaaatcctccaattcccaggctgtaagagcttcattttgctgatgaacaaagaaaagagaacaaaagacctcatagataattagaggacactcagacaataaaccagtgaaagtgttattagtaagagttagggtagaatatcctaggtcaggcctcatctttccagattccttcattcattccttatttttcagtcttcatttatttttaaaaattcctccatcatacatgagcaccaacaacgtgctaatctttgttagttttggagatactggaataaataagacccaagccccgcccacagttctcaggtcatagacaagattccaatataaatcaaggacttgttaatgtcttgatatagatatttaagcaccgagaattccgtgagttgttttgaggggaatggagaacgggggaggcatcacagagtaatatagtatatgttcccaagacaaagaggtccaggcagagggaacggtatgggcaaagtcactgtggcatgagagaacatgcaccattttgggcactataaattgttgccatctgttggagcttaaagttcatgtggatataatgtgggtggtgcatgtaaagggatgggggtgtgggggttatataagatttttgtatcggagatggacaggaaaataaattagccaggagagaaagagaaattggtgtctgaggagaatttataattcacaagcttgaaatacttcaaaaacataaatatgacttagatactgtttatccctactctcctattcatccctccacaccctactcagataccttttcctccaggaagcctctctagctcccccagaatgattagctccatcttctgtgccaccgcttccccattattgcatcgaccctactgtctgtcagactcctgtccacccaccctccctaggactccttgatggcagagaggatgcatcctcatttcctcagcatccccagtgctctcatatgccctggcacatgctaggtccttggcaacaagtgctaaattattccaagtcccctggctgcccaggcagtggtcctcacctgctgcgagggtgatggtgctgagcttcacacggtagaggttgctccggacccgccactgctgcaccatggggtaacccatggcctcatcatacctgatatctcctgggagagaaaataagatggtcacgtgagcccagaattaagacgcttcacaccacattgttcaccctgcagctcttggctctgggaaacagacacctctttgaagtacaactttcactgggattgacaattttatgaaccccaccctccaggcctctttctggtctctaatctcagccctacccctcatttttctctctgctctatagcttgcaagtcccctttaccctacaagcaagagcaacctcaggtcagatctatgtcttacctaaccccatttgcaatttgccaccaggcactagacatcccagtgcttcagtttccacatctgacactgtagctctctctaatactcttatttcgtaggcatgttgtgaggctcaagtaaggtaccagaagtgggagccctctggtaacctagaaatgttgtgcatgtagaccacatgtaagtaaactacagcctatttgttatgtattttctgtagctgctttcacactatgacagcagagttgagcagttgcaatacaaaccacctgcaaaggctaatgcatttattaactttcccttcatgtttgctgacccctatgtagactatcatttcttaacatggaaacatggatgttcataagtattatgtaaaatatacgtatacagaaataaactctttctatttcaagtaagactgagaagcacaggcaaaacaaagtttaactgtataatttctcagcatcttgattatattaatatgcatgaaagtagtgtgcaaacttctttgaccataaaaccccttttgtatgaaaggtcctttggaattcatgttttatagaataaatttcaggaaacactggtgtaaacaagaaataaaaacagaaaagacacaacgaagtgttagcaaatgattaactttgggcggtggtaaatgaaaaattcttgttttctgacttatattcacatctattttctaaattttctaccctaagctttgcaaactctcttttttataagctgaacaaaaatacattaaaaagatgctagtcacatcagcagttattattactgtttttatgtatccacactttcttgtgcctctgcaaatggcaggcacattttctatccttttctcttgtcccctggtgagtaggcacttaaagagatatttgataccaagattaaaatgagaatctcattggaacaaatgatttcttcctggacattactgcagtattaaagttgtccattactgtcaactttttttttttcctccttatgctccttagccttttcaggaataaaatagttttttagaggctttcattttaaagtaaaatattcatgatccccaaagatatgtccactggagtgaggttgtttgttataaatacatcctctttgtttatctgctctgcctctcctggccttcctttgcagaggctagggagaaaaggagattgtgtggagggaggaagggagggctatgtttttgactaagggcagagaaaatgtctgcacaagaagattcagacaccagggacaaggcagtctctgctccttccattactgctcattcatgttcaaagcagacttgctgggggcattggcagccaaggcctatctccaacagaagaggcagaatgatgcaggctgttgagaggcagctctttcacttggtggcatgatgtccaaacataaaaacaaaacaaatttaaaaactccttctgattatcaagtaatttgtaaaaccatcttctcactccatccctcacttccttccatctctgctcattcctggattcatgcctgaaataaaagcttctccaatggaatggatgtcagctttttgaggtcaaggtcacggtctatattcctccccttctacagagcctagaagagagcctggcttatagtagcctctcaataaatgcctatccactggcggcctaactctcactctgttcctaaccataaactcatccctgggttactctatcgctgactctcatcttgccctccccatctcagctccccacctggggattatggttggaatgaagctatgtgatggagggaggaatttttcctggtaataataataataataataataataataataataataataataataaatcttttgaaatgcaacagttccctttattaggaaatctccaaggatccttgagtcaaaacaaagaatcataacaatttgaaccactaatggatacccatagtgtgccaagcattttatatacatgatctttatttctcattagaatcctaaaaaaaaattatcataccctatttttttgttattgtgttttgttttgttttgttttgtttttgagacagagtttcactcctgttgcccatgctggagtgcagtggcaagatctcggctcactgcaacctccacctcctgggttcaagtgattctcctgcctcggcctcttgagtagttggaattacaggcacccaccaccacccctggctaattttttgtatctttagtagagacggggtttcatcatgttggctaggctggtctcaaactcctgacctcaggtgatcaacctgcctcggactcccaaagtgtggggattacaggcatgagccactgcgcccggcccataccctatattttagaggaagaaactgaggctcagagagcaaaactgtccaaggacataccaggatcaatgacaggttcaggggcctttccattaaagcacagcacctcctcacagaccgtggacatgtctgctttaggaggtagtaaactccccatcactgggggtatccaaagagggataaccactcaggaaggatattatagacttgattcctcattaggagggaagattagactagacaccttttgcagtccatgttagctccgaaattttatgatcttaaaaaaaatgaaaattaaggaaggcatagaaatttttgtaacattttacaaggtgtcttttacatccatcatttcatttgatctacatctgggtccctctttgaaatagcacaggtcaggggtgatgtaagatagtggatatgccatcagctttggagtcaagaccgactttgtttaaatcttgacatgactatagactagccacgtggccttggattagttcatgtccttgctaacaagtttaaaggggacaataatggccttgcagggttacatggtttaacacacaaaaagtgcctggcccccaggaccccttaagcacatgtgggttctctcctccatctatgctcttttacaggaaaggctcacgggagttagatgactcttttgaggtttcccagagcttgcaagtgatggggaagtcagacagagatttcaacctaggtctgtgagattgtggggtcttccctggggaacaattcccctctcagtgaaagagctctattatccttccccatgacgattcccccgtgactattctccctgggcagtggataaggcacacaaccacagtatcacaaaggcagagtcgagaacctcacatcttaggaaatttcttaagaaaagggtaggagaggaactgggagcaaaaaaagaggaaagagcatcctggggttggacagaaaatatggagtctcaggaaagcctgcaaaaggcaacttcccagtggagagagaaagtggttgcaggggtgggggagcggcaaagtggagtagaaagggcaaaagacttggtgctacagcacccaggttttagtcctggcagatatgctgtgtaactttggactggtcccttctacctctctaagtatagcttcctaatctatcaaatggtaaaaataatacccaccccacagatggcacagtgcccacgtacaaaaacgagctgtgtaactcgagtgctttcaagtaggaggggctcctgattggagagtccacttcttttactttggaatgacttaaaacgaaccaagaaaacaaaatactaacagtggaaaaataccagaaaattgtcaatgagaatgaaaagtgttttgagactcattcacagaggcaaaactctcactgagaaaaatcgttcctgttctcacagaggaacctcctctcaaagatgactgcagtcccaagtctgaggtctcagggaagtccctggttctgctcagccaatagcaggagcccaagaaagggtaagttccttcccatacccttcctcatgaaggaggaggcttgacagagcccatcttggatctgctgaagactgatatgcactaggtgtggagactcggtgtgtggtcagggaacctgggaagggtctggcacatgtgtcttaccagtgagcagttggaggtctggaaggggctcggagaggaccccccggcactgctcctccaccggcagcgggatcaccaacagcccatcggccagctggggaaagtccttgatgaagttgttctccctgtggagaggagcagagagactgccaaatcgaggaagtggagactgctgaggactacagggcaaggaggcaggatgctgtagtcagaataaagactcatggtggggtgactttgctgtaatgcctctggtttcctgaatcccagctctgagaacatggtgctaactacaggttcctgaatcaggcaggctggggttcaaatttagccccactgcttacttggctgtatgatctcaagcatgctactgttcctctcagaacctcagtttccttgtctataaagtgagactcagatctaagggctgttgtaagcacttaatgggaaaaacctaccaattatttaagatactttctgatgctctataaactgtatgtggccgctaaatgtcccctggcataagcagtggcaatgttgaaccaggatgtgagaactgagaatagtgcgtagtgtttgcagaacaaggggcaagactaggctgaaaaaaagaaaaacaaacaaacaaaccttggaaaaaatagatgtttgttaaatggaagggccctaagagacttttttttttggctcaaacttttccttttacagatggggaaactgaggcctggagaaagggaatgacttgctgaatcacaacctgataggttagactcaaacccatgtcttctgactccaggttagtgctctttcccttgctctaacttctttaggtgcctctaaccctttcctgcaggccagtcccagggaacagaagacagacctctgaatgaccccagaaaactgaactgtgaacaaagttctgagaggatggtagtaacagtgcagcagagggaggcaggtttcattcttctagacaatagacctgcctaaaaattaacagcctgccaagagaggtggtgagcttcctgttactgagggtgtgcaagcagaaaacttggcagccagttggcacggatggtatcgaggtcttttccaaattaaatatgacttatgaggtccctttatattcagaaattcccagcattaaagacatgaattatagtctggagaggaggaggagagaagagaagggggaggagaagaacaaaaggaggaagatgtttattacttcattttgacacatggaatggtcaaccttgaaatgaaaatcagaagcacgaaaacaaaaatatgtgatgccaaagcaatgcctttgaagcctgtatctcagacagttcaaaagcagctgtaaaagtgttgagtggcttgggtcaccttcctgtctgctcaacatctctgcaccccactccaggcacctttgaagctcatcatcaattcatccatttaatgaacactttcttcatttctgagtccagaggatgtgacattatcaccatcttctataccaccagcatcaccatcattatcatcattgtctttgtcatctatattattcattgaatctttataatttgctaggatctagctaaatactttacatacattttatcacttaatcttcacagcaatcccaaaagatagatattattatctttaagttgcagacaagtagcatgagatttggtgttaacaggtggtggagctgggatacgaacccaggtctggttgggcctaagactgtctgcccaggcatgcacgtgcatgatggtgagttttaaggcccacacttgccatttaaacatgctgctgtgtgtgggtgtgccatggctgtctgtggagtcatccttgtttatgtctgtgtgtgcctgtgataatgggttctacctagatggttggtctttgtctacaaatctgggagtgtggaacagcaatatgaatttaaaaagacaggcttctggtagatggaagtaccaccacatagcatataaccctagccaggactaaatgtcctcatgcttcccttgtgaggtggcctctggtgatagatttttccctgaaagatgtagcaggatggaggggtagtccatgccctagtcattcaaccagcatgcactgagcacatacttgggtggaatcctgtgctgggtggtgctaagaacacagagacagattgatgtttccccttgtcctctagatcttctcagcctagtggggaaaacacaaaaaatggccatgcagaataatcagtgggggctgctatcaggaattctgcatgtgctgggtgctgctgcacaaggtctcttccctacaagatccccagcacttgttttcactctgggcaggagaggctaagggtgaggaggtagctcagccttggaagctgagaagagcctatgaggactgggctccagttctgcccacactgcatcctagctgtgtaacctggagcaaaccaaccaaatctcaaggttctgttctgtaaaatggggatcataacagctattcagctggccttagtggaatggctacaataacaatagccttttattgagcacctactatgcaccagacacaattggcagtacttattcttcacccaactctgtgaagtaggtgtcatttacattccccattcagacattgaaaagctgaagcacaaagaagttatgtaactacctaaagccacaaggctgggaagtgggagatcccaggtggtttggccccagatcaaaattgagtaatatattgctttcaaccatgagttaagttttaaagttgattcaatctgatatttaaattttccagaattctatgaggtttaaaagcaaactaaatgcttaagtatattttatactttattatgtactaaaaaatgaccagattgtggtgttatttctcagcttgcctttccctaagcattcactcagaaagttgaatatagaagggttaatatttattgtatgcctggcatagagtctttgtttgtctaacaggtcatggtagatgtcttcaaaagacatcctagcactcctcatcactgcttgggtagagggtgctaaaggacctgcctgtgacacacacagactgtcagtgttggaagggccatagtgcctgggcgtgtgctgagcccagacaggatgcagccaagaggaggaccttgctgctcctacaagagaggagagagttagctattcaccacatgccccaggctctgttctctatgtgacctcttcaagcctcacgcaaatgccacaaaataggcatatattcccagtttaaccgacaaggaaatggattttccatggacttacataatggatgcatttgggaaatgaaatctgaaggcaaatctatcatttttcactttaccacccaagagtgtccatttcaaatctctagaaatgttcttacaattgtagagaagggaaggtaatgccaccttctctatccgcatgtccctctcttccaatccttctgccttcttatcaagtcactcttagctctgcaaggaaatctgaccccaacgggacaatgcaaggaagtagagtgtgcaaactcaggaggcaggggcctggctcaggacaccccttctcggaggaaggttttccttcctgagcttccagaaagtagaggggggacttggagaaatgcagaaagacagagaagatggaagggtgacagttagccagccaatatggaagactgggaagaagggtggcaggtaggcggagatgaagcccgaatgaacagcccagcgacggcatggtctctcgggtactgggtccctttgcgaccgcctgggcgatggccacaagtcctgcaaggcctctgccagcagagggcgcccggggcctttgcatcgatcagctgtttcgggaggcaaaacatggatgagagagtagctgctgggaaagttccgctgggctgagaacctcagatggaagcctagacaacagctgcagaacccacccacctgggagaggcgaccagggagctggcagggtgctggcttaaactcgggtgctcaggaataattcagattcttagcgctcgtgtgtgtgtgtgtgaatgtgtgtgtgtgtgtgtgtgtgtgtgtgtagtaaaaactaccacacaactaattcgtataataggaagacagaaataatggacaatatttatttattgattatatctgttgctcatcagttatgctgtagctcatgtgccaacgtgtgtgtgtgtgtgtgtgtgtgtgtgtgtgtgtgtgtagtaaaagctgctaggtaactaaccctagcaataatgataatatttacagagatttattgattgcatttgttgaccatctcctatactcaaggtagtgtgtcaagatatagtagcgtacaggaatggaaaaccaaaggttgtatgttctcacttataactgtgaactaagctataaggatacaaaggcataagagtgatataatgagttttgaggacttggcgggggaaggttggaagaggagtgataaaagactacatattggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaagactacatattggggccaggagcagcggctcatgcctataatcccagcactttgggaggctgaggcagaaagatcccctgaggtcaggagttcaagaccaacttggccaacatggtgaaaccccatctctactaaaaatacacaaattagctgggcatggtggcacccacctgtaatcccagctactcgggaggctgaggcatgagaatcatttgaactcgggaggcggaggttgcagtgagctgagattgcgctgagactccatctcagaagaaaaaaaaaaaaagactatgtgttgggtacagtgtctactgttcagatgaagggtgccctaaaatctcagcaatcaccactaaagaacttatctatctaatcaaaaaccacttgtacccccaaaacgatggaaattaaaacagatataggagtgtgtatgccattttaacctcataagaactctgtgagacaggtactatcattattcccactttatagacaaagaaacatgttcagagaggttaaggaacttgtccaactgaggtccatggtttgaaagtggcagtggccaagaccgcattctaacccctagcttccagctgagagcccagcacgcagtaagtacatgctcagtgaatcgatcccaagcctgtgctcttgatccctggcatagcttgactcatttagagatgagaccaggcagttctgttattcaccaccacagtggagtctgctttcaagaaagcatttttgagagatgcttgtttaaacaaacagtggctctgctgctgcttgaaacacaacattcacttacacacacacacacacacacacaaacacacagataagcatctgccaaatttatctataaaaacagttcaatctcagtcgacattctagggaaacaattcatcgattctaaaatagtagatcttgggccccggggactctggcagtgagaggtctccttcatttcacaaacacttattggagctctaacctttttcaggaactgttttgggtactagggatacagcagtggaaaatcagaggagatgcctccattcatgaagaccaggagagaatcaatgttgcattgaggtctacaagatccctcattatctagaccctgcctacttactcctgctgccttattgtttgagccacagccccctgggccactgttttcctcctgctctgactgtccttaagttccttttctggggcatgctcccatcctacacaaggacccacttagaatttgccctctctctggaatttgccctccctctggaatttgccctccctctgcacctgaacaactcctactcatcattcagaccatccactattcctctgcctttgagaactctcgctggaatcagttcttccattacacacccttatagtatcttgttgttttccactatgaagggctttatcgtttctaacgatacatgtgctcatggaagaccttgttggacacctgtctttcccactagactgtgagttccatgcagccccaaactatgcctgtccaatgtactgctgcctcctcagggcccagcagtgcaaactgagtgcctgagtaaaactgagaaaaagtaggtgcaccatgagcatttgttgaagcagtgaaggaagaaaacccagagacaatggtaatgtgtgcatgaccacatctattatgaagccctttctgatgttttgccagagtctcagaatgcttcaggatctaaagcatattgaggatttgagtctaatattccataagaagcttcaaaaccctactttcttaccctaaattcctgagtgcatacatactctggctcccatggagcttggacagaggggccaggggccactgagtgagtgggaccagatgagaaaagatgatctccctaagaaaggggttggttaaacctcccattcttggtgtgcatatgtgcattcaggtagaggtagtggtgtgggcacattctaaaatgaacaatgccagtgggcagcaaaaggccccattcaaaaaccatcatttccataataccattccagttttccccagttgaaatacatcttttctatcactttaatttcatgcatcttctttgtagattccagatgtggccttgggatctagtgatagaaagagcatgggcttagaactcatacgcacatggatacaaattctagctgtgtgaccttcaggagtatcacttcaaattttatgatccttagtgacttcatctgtaacatggggataatgagttcagcttcaatgcgtgaagaggaggatttatgtaaagttattttattttatttatttatttttttgagatggagtcttgctctgtcgcccaggctggagtgcagttgtgcgatcttggctcactgcaagctccgcctcccgggttcacgccattctcctgcctcagcctcccgagtagctgggactacaggcgcccaccaccacgctctgctaattttttaattttttttagtagagatggggtttcactgtgttagccaggatggtctctatctcctgacctcgggatctgcccgtgtcagcctctcaaagtgctgggattacaggcgtgaaccaccgcgcccggcggtaaagttatttttaatgctagcttattttcctgaatcccatactagattctgaatctctccaaggatctcagagggcccagcacagtgcctttctcactgtatatgcccctgagcatttgttgaaccatgtgtaatagaaggggaaggtctctttaccctcccaggctacctgcatatgacctctaaatgacagaaatcctacaaagcatttccactgagatgcactgtgtctagcttccttctgatcagccatgctgacagcaaagacaaacaagggaagctggactcctctgccactctgtcctacccttcctcaggtctttgctgcctgccgcccccttttaagaatatgtgtgttttgggtacattaatacacagcagccagcatgcaagagccatcacccctcagttctagggaaattagcatttaaattgaggtattccaggaaggtaaatcaccttagagccagccagcactgtctgcagtcttttcttacttgagggaaagctaggagccttggcttgggagctattgagtttgcagggaggggcttgctctccttgcctggttctctggctcttcctacactgcccataagcctcaaaaaaggttgccttaaaatcccaaagctgatgaggacatattccctggtgtacactgtgcctcatcccccctctctgactgaactgagcctttatgccaagtgacaggatgactttggctgagatttggtgtcctctgacaacaagcagttgggagacctgtgttctcatcttggctctgtcactggctggctgtgtgatgtgcagaagccactgtccttctctggaactgagaagaatgggctggtacaaaacgtttgtctgaacctcaagctgggaggtgctgggctagattttgtagctgtcctgcaggtgccggagacatctatagggtctggtggtgataaattgatgctaacactggttggttggtaccagcccaccctgaagctctgccctcttaagcagcagttagaaactgttctcatatgctctacttcttaattatgcatcatagtttaagttctctggtcaagcactcaatatttagtgattccttcatttaaccattcattcgttcattcattcattccttcattcattcaacaaatatttactgttatttgtcaggcattaggaatacaacaataaaaatgacaatctctgtcctccagttactcacaggctgataggagacgcacatgtgtacaaatgccttctatgtatgtgtgcacatgtgtgcaaggtaaatcattgttttgaaaatgttaaaatgtttttcattctccggaaatcctatttcagctttgcctctcaaagttgactttgcagtgtttcaagctggacaatagtttcaaaacccagcctgtgctgagggcgaagttcccttctctatcaaaagacagacctgctgactcagatcattatgttttattttaatatacagattgggcaggtgatggcctcacagttgtacccaccagataagaaaaggaaatagtacactcttctttctgccactgatgctgcaaggaattgttgaagaggaaagtcaagtggctgagagttcagatgggagtgcctcagtgaccctcctcctggccttttggaagtcaaaccacccctcattcattccaagtacaagggtagtgtcaataaatgcttaagatatttaagaatctcgatacgggtgagcaggggtgatagggtttgctcccctagactcaggatatagtctgggaagtttgcaagcccctcgctcaacaagccaacaggagctcctgggagagggtagcagtaagtgaagaagagacttgaatttggagccacccatgccaagttctgcatacacagggtaaaggggataaaactgtcaagacttcctggccccataaatatgtgcaattgttatatgtcaattaaaatataaaattaaaaataaaaagacttcttggcataactccttcgctcccatggtggcagggatggtagatgaggctgagattagaacattagaaccaagggggcttcagagtgttgagacctaatgaccttggacattggctgtgtgttccaacacattgcttctctcaaaaaactacccaagaccatccatacctcaatggatgccagtgccagcgctcagagccaagctcaaacaaaaaatcacatagcaaataccagcaaggatccacaagaacacatttgtaccagagaccttccctcaccaacctctgccttctctgaggccaagttaaggggtaggggagactgtttggtaagggggagaggcaaggctggtggggagaatgcaactgaggcaagactggtggggagttgaactttgagtggactaaacgtttaccctagagaaaatgttttgtatccttaatcaaaaaatggaaatacttggccgggcatggtggcttatgcctgtaatcccagcactttgggaggccgaggcaggcagatcttgaggtcaggagattgagaccatcctcgctaacatggtgaaaccccgcctctactaaaaatgcaaaaaaattagccaggcgtggtggcggacgcctgtagtccacgctactcaggaggctgaggctgaggcaggagaatggcgtgaacccaggaggcagagcttgtagtgagccgagatcatgccgctgcactccagtgagacgggatctcactctgtcgcccaggctggagtgcactggtgtgatctcggctcactgaaacctccatctcccgggttcaagcgattcgcctgcctcccgagtagctgggattacaggggtgtgccaccccaccgagctaattgtatttttagtagagacggggtttcaccatgtcagccaggctggtcttgaacccctgacctcaaataatatgcccacttcgccctcccaaagtgctgggatttcaggcgtgagccaccgtaccaggcagaaacatgtttttgctatcagtggaatgaaaacttgagagaattattatgtcagttgtagaaaattaagacaacagtgtttttgtatactgagttgcagcaaaataatttttgaatgcttgactgtgagaatggatggttataggttagagggataaagtctaagtttcatcgggaaagttcagggacaaaggaaatgaagagaaggaaaacttaatgtagactgaggaggtcaggaaggctccctggaggaggtgagacttgacagattgggaggggttaacaagggagagggcagaaaaaggaggtgagggtggggcctaggcagaaagaacagcatgcacaaaagtccataggggtgtatgtgtgtgggcgcatgtgtgtgtatggaagaggcacagataaaacacatggcatgttctggaaattgcaataagctaagtttcaagatgctaaagcagcgagtgagaagcaaggatgggatagggctagaggaggccacatagggatcagatctcatgggttttctaagtgatgctacagaaggtgggcttcattctaagggtaaggagacccactgtagggtattcagcaggaaagcaaaaccatcagataggagcttcaaaaagactgcctgactacagggtagaggatggactgaaaaaaggctggaaggagggagaccagttaagaggttttgcagtaatccagacaagacataaccgattagatggacaacagaatacagagaagaggcacagatttgagagagagtcaggaagtagaacctgctgatctccattgccaactgcacgtggtggggagtaaaagaagagtcatgggatatattgagcaggtttgagcccaagcagtcaagcccatgctcctgtgctgactccagagacctgcctccccagtatttgcttattattagtactaataaccagagccctccacacatgcctgagttcattaaccacagctagaaaacagaccaatgtgctttgtcccatcacatatgtcctcggcctcctttctgcctctgctagctgtcagtccacctcagcttaactgctaactgtgagacccacaggaagatggccagatctcaagcctaacccccagcacttcaagcaggccaagtcaccacccagacggaggctctcagaactgcaatttgctccctagcagaatgcagcttgtgacccctactgtccagggtgtttcaaggaccatggctgcaaagttgctttactggcctatccagtggcccatacccatgggtccactctaatcacatctgatgctcctagaaatgataagcattactgttaccatttgataggaaaagaagcagaggcagtatagagaagtgtcttatttaaggccttgcaggtgttttcttggcagaattggactgactaccaatccctattcttagtttccaatccagtcctgtttcgacttgtgcattctcaagggttaggcagagtgacctctctacctgcctgataccttctctgaactgtgaactccttccaggcagcagctgtatttgtttcttctttgcagcctcctctgcgctctctcgtagacttcccagacagacctcgtggtgtcgtctccttcaggaagctgtcactgagtcccttctttggaagcaatatccttctgtttccacagcacttgactttggctctgatctcaagatcaccaactctgctaggtatgattgttctctgcacgtgtttcccatctcagattcaatggtcaatgctgcaaggatctatataactagtttccctcagagccctcctccccacagtctgattccagggtttggtatagacacagtccctaatagctgttcttgaggccatcatcccctctcatagcgactactacaatgacctgttaactatgctttctgaattcagccttgccccttccaattcatttactatcttgcagccagaacgattttctgaaatgtttctaacacaaatatgtcattagctccatgtattagcattctattgcagctgtaaaacatcatcacaaagttagaggctcaaaacaacattaatttattttatagttctctaggtcagaagtctgacatgggattctgggctaacatctaggtgtcagcagagatgtttctttctggaggttctaggggagagttgacttccttgcctttcccctgcttcttaaggctgtccatatggctcatggcccctttcctcaatcctgaaagccagccaaggcaaactgagtactttttttttttttttttttttgagacagagtcttgctctgtcacccaggctggagtgtagtggcgccatctcagctcactgcaacttccgactcctggattcaagcgattctcctgcctcaccctcctgagtagctgggattacaggcatgcatcaccatgcccggctaatgtttgtatttttcagtagagatggggtttcactgtgttggtcaggctggtctcaaactcctgatctcgtgatctgcctgtctcagcctcctaaaatgttgggattacaggcttgagccaccatgcccggccaattgagtccttttcacatcacacactcttacttcatcctatcctctgcctccctcttcctctttaaagatccttttggtttcactggggcctcctggttaatccagagactctcttcatctcaagatgagctgattggcaaccctattccacctgcactctgaatgttttcttttctatgtaagataactgataacttattcatgggttccagggattgagacatggacatcttgcattattctgccttcacattctaggtttttttcttttattttcagttttctttttccctaggaggactttgtcaatgcccctcttttcatttgggagttagatgttccttctttgtgtttgtgcagcccctgttctgctgctatgctagcattatcacactggactgttgttcccagtcaccctctgtctccctcattggaccatgagcactcgagagcaagaactacgtctgtcttattcactgctgtgcacccagccctaacgcagtgtctgatgcatgcactaggggctcaagaagtgcttattcaataaattgctgaatgtctcttagctgaatggcaatgtaggggagacaatccattcagctgtggtaccgcgatctccctcccatggggcctagtcactgccttattcatctctgcctcccttgccgtccttccttcacttccctagatatctagcacacagaataacaagtatcatttttaaagctaatatctattcatcgtttacgacgtgctagacattattctaagggctttgcatatacaatctcatttcacatgcacaacaaccatgcaaggtaagcactcttgttctacttttatagtgagggagcagagacataaaagaggaaaaatgcacagaacttataaggtgaggtttgaataatctaacttcatgttcttaaacactatgcaaaaatatgctggtgaatgtttaatttttccccaaatgaaatcctgaaaagtaaaggttgacttgttgcaaatgccgatgctggttgaatgtcttagatggatgccctttgttaaacgtatatcatgtgttaggttctctgcaggctttgtttccaaccctctcaacaaccttgtgagttaggtattattatctccctgccagaggtgggggaactggggctcagaggggtgagaatcactttcctggagtcatgtacaattgaatcagggccatctgcctccactctaccacctatctctccaaccatagtcacacttgtcttcttccctctttactgcccaccctcatttatacacaggtgtgcatgagcacacacacacacacacacacacacacacacacacaccacctacccccatacatacacagagtcagagtgaagcctgggttacacaaagcacatgtcttccctctctaaatgcaaaacaatttccaccagtggcaccaaactcacttaagcattccaggcatggctgttactaactcctgccctggtaattgcgatccctgaaattgaaagaaattgcaggctagaggaacattatcttctccttggccacttcgccctccatctcctttgcctgtgtgtattagcactgggatcccttgtcctgtcataacactgagaacaagctgagctgctgtcaccagggcctcttccagaactttcccctccactactcaaggaagacagtgaaaggccctcacaccttgacataaaatttagagatgtggctggagaaaagtcaacattactaggcatttttctgacaaagtattatcattatatctgttttccagatgctataaatgagattcagagaggaagattagccctgccccagaagctaaacacaaattgaaacctaaagatggcctccttaacagatctgcagggccagagtgaataattccctggttaaaagtggcagctgagctccttgatgagggggcacctcttagtccaaccctcctgctccagctccagccttaatcccaggactgcaggatgcagactgcctccctcaatccccgaggggtctagctgcttactttatcacagccaagggcagaagcccatatccctgtaactttcagtatgtttccagttcaattaggatcttcatattccagtattcagagtattttctaatcttaggaatcctctatctcacaccaacatttcactacacactcctcaagggcaaggcctggactccattcataccattggtatctcatgggtctagaataagagcagacacacagtaggtacacaaaaaacacttgccagatgagtccaagggtgaaggcgactgactctccctgaatcctagtgcatgttatcattccttatgcacccagtcctgccctggacagggagccaggatgtccaagttttacgaagctgtgccaataacttgctgtgtgatcttgagcaagtcatttcccatctctagggagtgtttaagtcctgaggtcatttatttgaataatgcaagtgtccccaaatggctccagtatgaagggctaagagaaagttctcaagatgagaagacctattctcatggacaccttatgtcttctctctcacctttttggaagtagtctttgcagtcacacacctggatttgcatcctggtccgccccccgtcccctgtgtagatctagttggacaaaacattgaacctttcctggacctttgtttcctcatcagaaaaatggaaataataatcatccttgcctcacatacttgctgtaaagatgaaaagagcccataaaatgaattgcttagcagaagacctgaaaatagcaggctctcaataaatggcagctattgctgctgtaaaatgcaccactctagcacattttaatttaacacactcaaaaagcttgttgtgattaggcataagaaggatgcaaatggacctgaaacccttttcttctcctcctgccctgacagcatgcacaatttgtccaagccacatgagagagctataatgagaatactggacatatggtcactaatttggggttattttctttacgtcatgggaatccttcccgcccgccactggtaaatttgattctttcctaactacagaacttacccacaacctctggtggagttggtaaagctaaaagcaatgctcccagcaccataagttgaatatctctcttcctatcacagcatgcactgaaattgccatggtgtgtctatttccctacttttggggggcaggaactaactgatatggtttggatgtttatcccctccaaatcccatgtggaaacataatccccagtgttggaggtggagcctgttggaggtgattggatcatgggggtggatccccatggatggtttaacaccatcccgttggtgacaagtgagttctctttcagttagttcacacaaaacctggttgtttaagcgagtgtggcacctccccttctctctcttgctctcactctcattatgtgatatgcccagctccccctaccttccaacatacttgtaagcttcctgaggcccttcccaaaagcagatgctggagccatgtttgtacagcctgcagaaccatgagctaattattcctcctttctttagaaattacccaacctcaggcatttccttatagcaatgcaaatagtctaacacactaactgtgttttctctctccttctgcagctcctaacaaagtactgggtgcatacttgatatccaattcgaaaatgtttgtagatgagccttcagtagactggacagcaaattaaagaaaaataacgtttaaaaactcttaaagcaaaagatagaaaataatcaaagccacattttaactgacgacacagcatcaattcatttgttacttcattccttgtagtagttagaaataaagaacttttttgaatgttaacatttaaaaccaagccataacatggactttggaatcagaacatatggcataaatacagctggttctggtgtgaatttgtggttggggtcgcatttctgaaagtttcttcttcccttttgtctttcccactctccctggggcaccttagaagtctttccatatagccacctctaatgagctttgcaaaatgagaaacctgctacagtagaagaaaatctaatagcaattgtttccttgttcactctctctctctctctttcttctctttccctctctcttttattagtcattagcaatggagaaagaaaacacccaaaggcagtagaaagacagtaatattcgcacgtgctttctgcaacactgcactaatgaggagccctgaccatcttgcatattccttcttattcaattccaacagtcctgtcataagttggagccacaagcagaacctagctagtgtggacattagccagtttgcttcataacaaaggtgaagtgtacatgctgttacaggacagctggaaattattgttaagtgctccttaacaccaagggatatcaagactttaaaagggcctagaaaaatacaaatccaattaatgaacagaatttttgttcttttcaaaatttgacatagaaatgtaattgaatccagtttgtaagaccctggatccagcttcccaccttcttagatactggttatgttgccatatgcaatcatacagtcatgctgagcctcaggtttgtctataataccctactccactcatagagagagggccttaaaccatacctcttactagatgtgctatcctaagcaggctgttaaatttcaggagcctcagttacttcactcataaaatgaggaccgtaatagtacctacttttataaattcaattatgaggattaaaagagactatgcatatagatagcctgtgtgcttcatggggtggtaaaaggaacaataactataaacagcctatgtatatatttgcctgtgtggtagttactgttactgtggttatttatttcctagtaagaagttcagagttaaagttctgcttccactcttgcaagtttggacaagttagcgtttcttactaagtttcagtctcctgatatgtaatggggacaaaataacagtaccagtgttgctgaattgttgtggaattaacaagataatgcatgcagcatggcacctgacacattatactgtgtgctccataaatgttaactattattattgttattattattattattagaaatgtgatttagggtttaaaaaataatatgcagcagaaaatcccagagaatccacaacaaaatactgctggaattaataagtgattatgacaagcttgtaggatacagatttacatacaaaagtctattgctttcccatatgctggcagtaatcaattataatttgaaattaaaaacaaaacatcatttacattagtaccaaaaaataaaatacttgggtataaatctaacaaaatacatagaagatctatataaggaagactacaaaactctgatgaaggaaataaaagatcaaaataaataaaaggagattccctgttcatcttcaatattgttaatatgtcagttctttccaacttgatctatagattcagtgcaatctctatcaaaatcctagtaagttattttgtaggcttggcaaactgattttaaagtttatttgaaaaggcaaaagacccagaatagtcaagacaatattgaagaagtaaaacaaagtcagaggactgacactacctgactttaagacttactataaagctagagtaatcaagacagcgtgatactggtgaaatgacagaaaaagagatccatggaacagaataggaagcacataaatagacccacgcaaatctagtcaactgatctttaacgcagaagcaaaggcagttcagtggagaaaaggtagtctttttgacaaatggtgctgaaacaaatagacatccatgtgccaagtaaaaagaagggatgaagaaaagaagaagaaaaacagacaaaaatctagatatagattctacacttttccaaaaataaaaataactcaaaattattgtaagtctaaatgtaaaaacctacaaaacttctaggagataatataggagaaaaattttagtaaccttggatttgattatgtgtttttagatacaacaccaaatatatgatccatgagaaaaaattgttgttggactttattaaaatgaaaactgctgctctgtgaaagatactgttaagagaatgaaaagacacgctatagactgggaatatttacaaaacatacatctgctaaaggatatccaaaatatacaaagaatacttaaaattcaacaagaaaacaaacagtaccattaaaaatgagcaaaagagctgaacagacacctcaccaaagaaaatatacagatggcaaatgagcatatgaatgtacacacatcatcccatgtcattctggaattgcaaattaaatgacaatgaaacaccactatataactattggaatagctaaaatccaaaacattaacaacaacaaatgctggcaaagatgtggagaaacagaaagagttaattgctggtgggaatgcaaaatggtacagccactttggagaatcgtttggcagtttcttaaaaagctaaacagtcttaccacgaaattctgcaattgcatgcattccttaatatttacccaaatgagtgtaaaacatgtccacacaaaactctgcacatgtttatgtgatcgtattcatacttgccaaaacttggaagcaacctagatgtcttttaataggtggttcaataaacaaacatccatataatgaaatatcattccacaattttaaaaaatgagctatctagccacaagaagacatggaggaatcttaaatccacattgctacaggaaaggagccagtctaaaagggcttcatactgcatggttccaactacataacactgtggaaaaggcaaagctatagagacagtgaaaagatcagtggttgccaggagttcagggagagaggcagagagaggaacaagtggagcacaggggatttttagggcagtgaaagtattctgtatattctgtatgatactatcatggtggttacatgatattatgcatttgttcaaacccatagaactatacaacaccaaaaggtaaattggggacgttagcaactaatattcaatcaatattggctcatcaatggaatacatttcacaacactaatgcatggtgaataataagaggagaaactgaaaggaaaagtggagataatatatgagagctctgtacttcctgcttaatttttctataaacataaaactgccttaaaaataaaatctattaacttaataatagcatgcatagtctaggtattttttgtagtcaattctattgttacaaagtgggagtggacaaactatacatctctaggcaatctgatgtccaccttttttttttattattatactttaagttctggggtatgtgtgcagaacgtgcaggtttgttacatacgtatacatgtgccataggggtttgctgcacccatcaacctcaacacgtcacctacattacatatttctcctaactctaaccctccccgagccccacaccttgcaacaggccctgctgtgtgatgcccgctgcccccacccccgcccctgctgcgtccatgtgttctcattgttcacctcccacttataagtgagaacacgcggtgtttggttttctgttcttgtgttaatttgccgagaataatggtttccagcttcatccgtgtccctgcaaaggacataactcatctttttttatggctgcatagtattccatggtgtatatgtgccacattttctttttccagtctatcattgatgggcatttgggttggttccaagtctttgctattgtgaatagtgccgccataaacatacgtgtgcatgtgtctttatagtagaatgatttataatcctttgggtatatacccagtaatgggattgctgggtcaaatggtatttctagttctagattgttgaggaatcgccacactgtcttccacaatggttgaactaatttacactcacaccaacagtgtaaaagcattcttatttctccacatcctctccagcatctgctgtttcctgtctttttaatgattgccattctaactggtgtgatgtccacctatttttgtaaataatgttatattggaatacagccacatccatttgtttttgcattgtttatggttccttgggtattacactggcagagttgagtagttgtgggagagcccacgtgtcctagagtttaaagtgttactattcggccttttacagaaaaagtttggcaatccctgttgtatagactctcaagctgaaaagtgtgtttaggagctgtttagttcaattacctaaaaaaaataaaataaaaatgctggaatcctcgcaaccacataattctgggaggaacaattttatagtctaacctctccaacaagtgtgaactttgacacaataatctcaagattattgtaggagaaatcaacttctcttcccttgctattcctgtaacccaccaggcccacaccttctgatctagaaatagcatgtcagagtagaacctggacacggactcatcacttacagccttcattctgaaccagttttgtcactcaaacccaccctgcttctgaacttcttggtactgactttctgctcatgcccctgccaccaactccggcttctaatttttagtttcaataccagatctgggtgccccagctatggcctaagctcctttggatccatttaaatgaaaaatacaatgataggctaaataatgaccttgaaagatattcaggttctaattcctggaaactgtgaatgacaccttatgttatgggctgaattataccccctcccctgcaaaaagaaaatcctcatatgaaattttcagagtcactccctccctgagaatcgcagaatgtgtctgtattcagacatagggcccttaaagaggtaactgagttaaaatgaggtcattaagatgggtcctaatccaatctgactggtgtccttttaagaagaggaaaactggacacattgacagcaggaatgtgcacagacagaggaaagaccaggtgatcacacagagaaaaggcagccatctgcaagccaaggagtgaggcctcggaagaaaccagccccgctaatgtcttgatcttggacttttagcctccaaaactatgaaaaataaatttcttttgcttaacccatccagttggtggcattttgttgtgacagccctagcaagctaatgtatcttatgtggcaaaagggactttgcagaggaacactctactagtctaactttccatctgcattaaatcaaaggtttaaaaatggggagagtatctggattatctgggttggccctaagcgccatcatgtatatccctgtaagtgggaaacagaggaatatctgagtacggaagaggcagaaggtgatgtaaacatggaaggagagactggaatgatgtggccacaagccaaggaatgctgacagctgagtgagacaagtaatggcttttctctgggagcctccagaagaaagccctcctaacaccttgatggtgaccctacaagactcaatttggttgttgcctccagaactgtgagtgaatacatgtgtgttcttttaatcactaagtctgtggtaatttgttacagtagccatgtaaaactaatggatgtgctttttcagataaatattgtttggggcttagtttgatttccaggccctcctcgtccacagccacccaacttttaagcaggcatcagacagccacttaatcactgttctgtccaaatgagagtagcatgcttatttaagctacatttctaggaactccgcagagaacaagctctaggggctcaaacttagtcttaacagatgccagagctcatggtctcaggcctattatagaacctatctaaacctcaatttcctaatcagtaaatgtggatcaaattatcaaccttctaaggttgttgtgacaattttaaatgatataagtaacacaaagaacacattttctggaatacagttattaacattctcaataagtaatattaatgatttctgtcattaattgtttgtggctctccagtaattccaagtctaacagatttccatttcccaaagccacagagagaatttgcaaacccatggcttggggcttagctctggcacctattcagtgaatttgtaccaataaatgtttattctaaaccctacccccaactcccttccactagtcagccttcttctatcagcagctggaaagttagctcaattcggcctccatccctgttacttccctctctcattctttgttatctccagttatctataagatgctccgaataaaacacacacacacacacacacacacacacatacacacacacttggtcatcggtgacttcaattctgctattttgcactaaaggaaactgagtggcttaaattcagaaaggcaaagtgatgtacccaaggtcacagagccaataagtgacaactttgtgaggtttccagggtgctattatgccacactgtgtctcacttgctgggcctgtctctccaaatcctccaccctgaaatagagtgcttccgcctacagctcctgctgaaatgggaaaagtgtttcctgtccacaggccagtcccctctccttccctttttttgaggactcctttcctcagggcagctcctagtgaggaaacagataagaggactccaagcaggtggtgcgaagttgtgagtcgccatgcccttgtgttggagaatgtggcaacacacctaatagtcctccctccctgcaggaaaccaggaaaccagcacttacccggagtgccttcctgctctgtcagcaatccagaccatatggttaattagctaaaatttgcgactgcatctgtgaagctatttttctttttggcatgcgtgaacttaattaccgaagacatgagaagttcctggcccactgggatcacggtgggcatgggtgtcacagaacatgcccatggctcagggtgtgagatatgtgggtggttgagagtttgagaaatgaaggatagagagagttgcttgaccagaggaggatggggtctttcttctggtgttcatgcagacatattagtaaagaatttcatggtgagacacaatgtcacaaggacccccatctgtgtatgtggacaagcatcctcaaaaaatggccaacccccttgcatggtagaatgtagggctcatcgtcttattaccccactgccctgcaaattctatcattagttgctccacagaatatttatcttcccagaacatatgactgtctcccccgcacataggacagggcctgtaacatagaaggtgtccagtaaagatggctgattggcccagtggatgagaccaatcatcttctgagccttcagtttctcatcggcagaaggaagatcataaaaaagttatatgcttaacaaattcttaatttgttaagaattaaatgagatatagtacatagaacacctatcacaggccctgatataatgacaggtgtttgataagaatttgttgaatgaatgaatgaatgaatgagcagccaattcaaacagaaactgaatgccattactagaagaagcctgagagatcaaaatctagtccagtccctccactgtgcctcagtttcctcccctgtaaaatgaggccaataaaatcacttctttattggattgtttgggaatcaaaatagcatgtagaacttttagaagagtgcctggaatgtagtaagaagtcaattaatattgctgctattgttgttgtgaataatagaaaatgggaaaacttattgctagcaaagaaaaaggcctcgcacaaagaatagcagtttgtggtgtgtcctgcattgtaacttggagctccttctttcagttcatactgctacttcctgagcagtatgggcttgccatgccaggagagtgccagggctcacaggacagacatgtgccagctttcaggggtcactggtatgacagaggagacaaattcccctttccctctttggaggacacccaggctaagaagtaaggtccagggttattttggacattattgacagaagaaacttatctatcaggagctctctgatgctcccaaacatagttttgcagattgtgccacagctgagagggcaaatggagactgaaattcatccctgttctgcaagccaagcttagtgcgtatgcagggatgtgtctccttttttcaattcacacataggcactgtattggcagctgtggcctcggagctttctctgggatcaatggacagcttgagggcaggagaacttgaagcccaagaacactggggcaggtgtttcatgggaccagggccattgtctctcatactcatctctgtattcccagggctgcctagtatagtgcttggcttagtggacacaaacacatgttggataaataagccactgtgttccttttattttattttttcttttaaagacaaagtcttgctctgtcacccaggctggagcacagtggtgctatcatggctcactgtaacctcaaacttctgggcccaagcattcctcctgcttgggactacagaagcgtaccgccatgccctgctaattttttaattcctttgtagagacaaggtctccacatgttgcccaggctggtctctaactccctgggctctagctgtcatccccacttcagcctctcagagggctaagattctaggcctgagccaccatggttggcccatggcattcttaatatctatcatagactctaccacttggtatgggcccagtttgtgctggataaatggatgactgaagcattcagaagaaaagtatgtgtgagaaatgatttcctagacctttagccctatagagtaaaagcaaataatttattgaggggcactgagctgtaaacattttctaccttaagtctcaaaacatacataaccgattgttcgcaatttacctatgagggctctgagatttgcctgtggtcatacagctcctaaggagcaataacaatatcagaacctgtgttttgctgctaccagtgcctgttttcacaaccatgctcttctcttctgggtcactgacttggctagtgagaaatataacattccctctgtctgctatactatttctttctgcttgtatactgatgacgcttttacttcattcatgcctctgcttaattgtcacctcctccaagaagcctgacgtgatcactgtgtataaagcaaaactttccaattccttatccttctttatttttctttatatcacttataaccactggaaatacatgtttattttctctctgctgctgccccatccccatctcttcccagaatgttatttccatgagggcaaggaccttaatctctcttgctaactgctattttaccaacatccagaatagtacctgacacataaacctgctcagcacgtatttatgaaatgactgagaggatgactgaaaaaccctgggtcagatagttaaatatccgtttaatgtcagatatgatctttctcttgcaggaccctggtttctttatcagtcagaaaagatacgaagtgccagacctgaggcttccctgtaaatacgggaagggctaacaggacgggtttaggagcttaccaaaaaaataagatatcattattatcattgcaaagcacatgtgcacatactccatggacacagatctttcatcctctccaggtagaacatcccaggtgactgccaaaacttccctgggctgggatgcacaggctagcctcaaagtgccagcttttgccacacccaggagaaaggcctccactaagccaaatcagtgtctcagtgttaagactattttttgaacagagaagtatggggcagcatttgtggcaccaacacttggtggccacataatattgggtgagtcacttgcacaaaaccaaagtaatgataacacccatctttgagggcacttgctagaatcaaatgaactgatcattttacaaacactttctgacatacaaagcttaacactgatgtaagaccctaaccttagacgtgaaagccaggctgagcaattcagacctgactgtgacttgggaacaatgggaggattccgagcgaggaacagacacattaaggcatatctttgggaagcaaacctggtagtgtgtgcaggctgggcctctgctgttggttcctttttttccttctagattgtgcctggggaagggggaggggagagaggtagaatctgcagtgtgggaaatcccactttgactctaccacttgcagaagggagtgggggtggcagggaacagacttgggtgacaggcaccacttgtgccaccctgattaactgggaaaatgcaaatctgcacttccttccccgccgcagctaacaagataatgaatattttcatcagctgcagagaatacaaacatctgtaggaacaccaaacctactctcaagggttgggggaggaggggaggacgcggaggtggggaaacgcagcttctctgcagatttagggaagaggaaatgtgctgagatgctggaaggatggctgggagctggaaatgggcagctctggctggcgcctcccatgcatggtacaacggggaatagctaactgtcctccacccctcatatctgctgttcattcgtggttgtgcatgttgtcactttgtccagcaaccttcaatttattcacctgcacctgcatcgatccctctgcccttccactcatcaagtcactaaacatttgctgattgctattgtgtcccaggcatgaacctaggctctcagagaacacagataaatgagacatcccttgtcctgttgtcttaaagtagctcattcattcacttaatgattaaattcttattaatgaagtacctgctgtgtggtaggtactcacaatcctgttgaaatagacatgggaactggcctactcttgaaggtgctctctgcaagagaagagcgcagagtaggaaggatcactcagcctttcacggaaagaggtgttcaaagaagactcctggaggagttggcggactcctgatgtcaatcaagaatgaatcagagtattttaggcagagaaactagaagagcattccaggtagagggaacagcatgtacaaagtcaagtaggcatgaggaatcccagggaactcagggaactacaagcagctctgtagaaatgggtgatagcaggtaagacaaggggtgggaacagtgacgggagacacttgagagatgggcttgagtccaggtatctggaactgtgtccaccaagataaagaggttagactttatcctgggcacaatgaggaggccctgatgagctctgagcaggggagtgatctaatgagacctgcatgttagacgatcattctggctgctatatggagaatgaattggagtgaattcaggatgaagaagagcaagggagctgttgaggattcctgtcccttatgcaatattcagaaagaattggagagaacactctgtgggtgctggcgaagattcttagatgtggacatgcagctttgccatttaatcaggtctggtctgtggctttgcatagctccctgagagtcagggcctactaataattcctcctttgtggagttttcagtgaagaactaatgagataatttgtgtcaaagtgacctacaaggtctgaggcactgttgaaatattagttatcagttatttaattatagctgtaatattggctctaatcattactttactctttcattcttatagctgatattcagaaatgaaaaatggtaaaaaattggagcctcaaggtcctggttttgccacttgttgtctgtgagcttggaaaatcccctgcatctctgtgcttcagtttccacatctctgaaatggggatgatatttttctctttgtctatcttgcagggcctccaaggagaactaatttggataattgacactgaagtgctttgaaaaacataaatgcttagcaacttgaagtaggtggatgtggactcttatctattgagtacctgtcatgatccccacttttgtagattaggtgttggcaaactattaactgcaggccaaatccagacttctgcctgttttgtatattccatgaattaagaatggtttttacattttttattgcctggaaaaaaattaaaaggtaataatattttgtgtgacatgtgaaaattctataatcttcaaaattcagtgtccataaatgaagttttattggaatgcactcacaacacactgagtaaatgggtggagggatggattggcttccatgcaagagttgtctatggctgttttgccagtgcaacagcaaagctgattacttgcaacaaagatcaggtagctggaaagctcaaaatatttactattgaggccttttcagaaagtttgttcacccctacttcagacatattgacttatttgattgttgcaaccctatgacattgggatttgttatttctctccgtttcacagatgatgaaactgaggctcagagaaattggctcattttcccaaagagatacagaataaaaactacttcaattccatgactactttattccaatgtctgttctctttttactgcaccatgatgctctcataagaggcaaattttcctcctttctgaggacccccaataatcatggcttcagtggctgtcctcctccagactacaaactgtgtgagggtagagattgagacaatcttgtttgtcactgtctatgcaatgtttagcatgtcgtttggcatgcagtaggtgctgaatagtaattctcgctgttttggacacatgtgctaggggtagccacttcattctatcacagtttcccccagcatttatgagcatcagtcttaaatttataaggtatactcattttctcctttcctttttggaagtgagtatcactctgccccctgaatgcagcaatttggagacattagcacaccttctgttcacacaaccactcagcgcccccgaaaaccatcttcaaatacccaaaacttcttctccaggccaaacccatcactcagacttcctgcaaagaggcaagagaatacctatggagggtattctatggagggtgatatgctgggagaaaacacagcctcggtttgtttaaggatgtagagtcagctagacctggatgttcatcctaactcccacaatgattggctgtgtgacatagggtaaggtcttttacctctctgagtttgtttctttgtgggtaaagtggggatgctaaaccccagctgtcagggttacagagaggactgaataggatgataggtggagaatttgcattccagcattgggttaatagtagatacccagtaagctctcctatggtttcttttttctgcaacatgcaaagcactgagctaggccattgcaggtgggtctctgcgagagggtgagggagagaaacaaccagataactccagtaccagcagggtaagagtgctgcagaggaagcccagagaaagagaaacaggatgtagctttcactgagcatcccttgggggccaaatattctgaacacatcactcacagaacctctgagtctttccaacactcctatgatataaggtgcatttttttcacctcatggataagagagctgaccagagaaatcacatgtctgggccaaggtcatacagctagtgtggcagaggctgtgatgctccggccaggttcccttcaagcggggactggtcccagatgctgcctgtgtcgctagcatgcagtctttagctgtcagcccttatggggactgcctcggcctcacctaaggtcctgcccctgctcggtatgacccacaaccatgactggttattgcaggagtatcaagatctaaatgtcttagcccagtttgagccaatgctgaagggcctctttagtcctgagctccctatggggttggctgaagttgtcattgagcctgtagggcagctgaacttcttctccctggtcctccttctgccctgtcccttccaaggtgtcaataccaaagccactccttaaaaaacattctgcttgttgaactcagattctgttttcttagcaaacccagtttgcaatgacagttactcagtgatgaaactaacaattgaaccacatctatttatttctccatttaacctctttctgtggataacttcattactattaatagataaagtcattcattcatttacttattcaaatatttcctgaatcttccaagaagtgtgatccctttcttaatccctgccttcaaggagtttagagtacaataagcttacattagttgtttctgatataattgtcgtcctacatttatgtgagtgctgacatttgagaactttaactgttcttgttattttaattggaagttgagagcagtataaattttaaaaaataataatggtctaatgcagacatcagtctaatcctcagttcttctgagatgcccccaccgtacctttgtatctgcatgtgcctgcatactcaaccccaccacttctgcttttgtctccattttcctcctcatttaattctgtgtcaatcctctttatctttgagagacgctgtgtgaaatgctgatacctctacaaaatacgtgctaatgacaaatttgaggactgaaacagcatgggctgaattagggtaattcagcccaagagggttccttctgagcagaggccaaattctacctgagagcatcatccgatatggcagagcagcctaatgaacctttccttgcagagaaagccctgttctccttctctctctgcattcatcaaccagacaccctgcagctgagtgcacagacagttcctggccccagagtcgggctaggcaaggtctccaggctattcaaaaccccttccccacagcaataccatctacctccaatctagctagctcagtactttccttaagccaccgcattagggacttgaagtgtaaactagtttgacctttcttaagggtatgtgatattgggtatcaacatttaaatatgcatatctcttgcccaagaggttttgcttctgggatttatcctaagaagacaagcagacaagtgtgcacagctgtatttacaaggatgcttactgcaacatagtttacgatagtcaaaagctggaaacaatctaaatatctatcaataggtgattgattaaatgaattataagtctaggtaatagaatactgtacaggcattaaaaaatacggctgatctttaaaaaatagaagggaaaaatctctagggggtattattaagtaaaaaaaaagacaagtgtacactgtaccatccttacatgtttctgtatataacatgtgactgaaagcacagagtgacacttggaaggaagtccactaaaatatgaaggtggtcaccagcatatggaacttcagagttttttaacctgttaatttttagaaatattgcttggattttctacagaaacatatgctaattttattgggggagggaataagcgttgtgtggccttgggcaaataattttctctttcaatactgagtgaaaagggggctactattacctgtcaatataactattaagtattaaaagaaaatgtatctaaggtgtttaaaagagagcctaaaacatggcaagcctccatttatggtcactggtaatagttattataaagatcccgggatagggcagacatcctatacaaatggcctaaaactatgacaaagagacgacaacccccactgggccaaacttgagccctcttacccccatgggtatacacgcacaaatacacacgtgcactgacacacacactcatctcacattcacaaaacaccagttacactcacatacacttaaccacacatggtcacatcacacacattcacactcatgcacacatatacaggcatacattcacatacatgccctcacacaattcacactcatacacacaaacacatacattcacactcacacataaacacacacattcatactcacacaaactcagtcacatcacacacacaagcacacacattcacagtaacatacacataaatgcacacacactcacatacacaaacacatgcattcatactaatcacatgcattcatactcatacacctaaacagtcacatcacacacaagcatacatatttacagtcagatacccgtaaatgcacccacattcgcactcacatacacaaatacacacattcacactcacacattcatagtcatacacttaaacagtcatatcacacacacaagctcacacattcagtcacatacacataaacgcacatacattcatattcatatacatctaaacacacacacattcatacacatatgcttgaacacacagtcacctcacacacaaacacatatcttcatactcacacataaacacacacattcacactcacatacacttaaacacacacattcatacttacacataaacacacacattcatacttatacacctaaacacagtaacatcacacacagaagcacacagattgatagtcacacaaacacacacattcacactcacacataaacacacacaatcatactcacatacttaaaacagttgcatcacacacacataaacacatacattcatgctcacatacagttatgcatacccagaaatacacatataagaacacacaatcctacatatacacacacacacacacacaggtgtgcatgtttagaagatggagagaatgaggcctgaagaattgactcaatgggaacccgccccttccctgcctgccaacctactcacaccctaggtaccctccacacaggctccagctgctttttgctggctcccagagcttatctccctatgagaggagggaggggtggcttgggagagacgagggtgattgttcaggtttaattaagcatgccacccagagacaggcttggcggatgcactgtaagacacattccgctgaactcagaacctctgttctctaggcgtatgcaggcctgacaaaacatttcaaagcagaggagaacattaggaacggagggagctgacagctcctaatagcacagtaacaaggagacactaataaagcgtgtggctgtgagctgagcagctccagagacagacggagactacaggccttcttcaaaggcatgttggccatgcatggaccttgcttttggtgacttctgtcctccacacatcacagaacagggatataacctcttggtgtactatgctcagaaccctcgtgagcaggggtccctgcagccagaactagcagatccatccttgctgagagccctcttaacaatgatggggaacagaggaatggagcaatgtggtaaatatctccagaaggaaggaaaacagggagggagagaaggaagaaagtcctccatttcctaatggcatatctatggtaaaaaagtactaattacttccataagcaacccatgcaactattcatagatctagttatcttttcaagacaaatgttactaaacacctactttgtgccaaactctatgcattgaagatgaaaacaaaacaaaacaaatcagaaaaataaaaaagaccttgtcttcaagcacttagcagtctagtagggaagtcatacaagtaaaaaagacaattagaatatattgtaaactcccaaatccaatgctctctctccactttcttgttaaattcttctttgaaaaagagttatgtcactgattccaatttctcaccactcatcctcactcaacccattcctatctgctttttgccatatttattccacatatcccaccttaccgtggttattgatgacctccaatttgccaaaactgctggtctccatctttctcttactcttaggtgacctctgagtagcctatgacacagaggaccaaactctccttaagaagcatgttctcctggagatcctgtgacttcccagcatctggtgtttctctgcctccctgacccgtcctccatcactggctgactttttgttttcttgtctccatttccaaataatctttctgagctctttttctacctacatttcccctagacaattgctatggtctgaatatttctgtccctgatgaattaatctgttgaaattctaatggccaagatcatggtattagaaggtgaggcctttgggaagtgattaaatcatgagggtggaaccctcctaaatgggtttagtgccctgagagacccgcttgcctcttccaccatttgaggatacagcaagaaggcactgtctgtgagctagaaagtgggctctcaacagacagcaaatctgccttgattttggacttcccaccctccaggactataagaaataaatttatgttgtttatagattatccagtttatgatattttgtatgggagcacaaatgaattaagaagacaatctcatctaaaatattttaaaatcatctatgctctggtgactactaaatgggtaagtttgggactcaactgtgaggtgtatttgcccatcaaatgaaattattatgaccagttggatataccttactttactataaagaaagacccaggctggagatacagatttcaaaaacaacatacatgggatgctctgaaagtctgtagcccagagaaagtgtgtggggagagaagacaaaaatactaagcctaaagccccaagaaggctgggaagtatctaaagaggcaaaagaaaaccagaagtgtactatacagagaagtcagggaatgagttttcaaatgagtaaacaatggtgctaaataaaagagttgggatgaactgaaaactgaatcacatctattggatataaccataaattggtgcacttttggccttgggagaagcagtgactgtgagtgatgagtgtagaaggcagactgtggtgggcgggagagtaagtgggaagtgaggaagtggagaccatttgcatagatttctctttctagaaggctggctgtgaatggaagacataaggtggtagctaaaggcaaatgaggaggggatgagtttggagagacaaacacttatgggctgaaggaaaagaacaggagagaggaagatacttaagtcaaaagaagaagttattaatgacattgtattccttaaaagattggagaggatggggtaagtattaggcaggagaagaaacacctgttcccctaaggcaggaagagatgcaagaatatatgtgtatgtggcacaaaagaagaaagtctgaaagttatgctctttcttgcctgatgatctcacttgtattttgtctttaaaatagtggatgaagctgggcacagtggctcatgcctataatcccaacacgttgcaaggtcgaggcaggagaatcacttcaggtcaggagttcaagaccatgctgggcaacatagcaagaccccatctgtacaaaattaaatatatatatatgggcatggtggtggggtgcctttaatttcagctacttgggaggctgaagaaggagtttgagtttggtgagtaataattgtgccactgcactccaacctgggaaacacagcaagaccttgtctaaattaattaattaataaatagtgaatgacataagaatactgaggttaaattgggggcataaacaagggctctgagagttaaaaaaaaaaaaaaaactaaaaagctaccgcaaggatagagaaaaggaggagatcaacaagagaacttccaactagtgtcaaagacccagccgatattggagaacatagatgggggttggtgcccatttgcactaggtgtggattatgccaactgcagatggctattcccaaggttgtaggaaagatagttgattttttttattcagatctaggggtctataccagaccagtcctttcctcacctacatcttctacaggacaatgattatagcaacagcagctaccagttgctgagtgcgggttatgtgccaggtgccttatatacaatatttttaattcttagaatagtgctgaaaaactatttccccttcatcctgagaaacccaggtcccagaaaggtgacatagttgatccaaggtttcatgagcctgtctgactccagatccctggctctttctctataccttgtcacaacctttgaggcttgacatcagctgtcatttcctttctgagcatttgcttctccaagataaacagttccaggctttgaacaccttcttatggaagcttctttccagtactctcctgttttccttcccaaattgttagtttcctgttcttgaacacacatgtatttacatatgtttttttcaaggtgatgagtaccctacggaaaagccaagactcctcaataaaaagttcttgagaaggactctcttgagggttttccccaagggcaccttcacatgttttaatctagtctcctacctaaaccaatgtgctaattaagatgctctctgaggagccaagaaagtagaacctgccattatatggagcttcaccacctctctggctccccttgcaaaaattgatcctgtgctccagaaagaccaaaccatttactgtcttatgtattttctgtcatgttttctgctttattcatctgctgatctctctgcctaaaatatccattcctttgtccttgcctaacaaccatttacccttcaagattcaactcagacatcatctcttagaaaccttctcaggtagtctggctacatcaggtactccttgcacttcatgcttcctctatcatcacacaggacttgtagggcacagtgattaagagaggaagctaatggactcaccagtcagactagacaagacctgctacagggcacttaatgattgtgtcactttacccctccatgttcccatttttcagctgtcagtggaggatagtgaatgtctatctcataggtttgttgtgaagaagaaataaggtgatccacataaagcacatggcacataatcaatggtagttattcttataacatgtatcaaatagtactacatttatgcttatctttctcccaccatcccataagtaccaagagggtaggaacagcatccaatttatggttctactcccagcacctcactcagaatctggcacatagtaggagctcatgaatgaatgaatgaatgaatgaatctaattcatctcagtgtgtactgtctttgggatcacattatctgaaattacctacttaatttccattatatttagagtgaagatgaagggtaagatatatctttttcaattaaagggcaagaggcctctccaagaatagcctgatgacatggagatttatggatcaagtgccaggctctcagcagtccatggacagttggccatgcccaactggaatatggtctctttcatttagaaattgtcaaggccaagaggccaggcagccaggagtgtaggcaggcaagagaacatctagggtacatggagggatgaggactctacatcagtgccaacattccactactactcatgcaaacaacctttcttgctgtttatgactggtggtcaatctgatagctccaggatccatcctgattgcctggcagccatgccattatatttacaaaatatattaaatattctctcttttaaacatcagaatcctaggttcccagcaggactgaaaaagttgataaggaacccaattagagaactgcaaatgcaaagactagatttcaggttgtgatatggtttggctgtgtccccacccaaatctcatcttgaattttagctcccataatccccacatgtcacgggagggacgtggtgggaggtaattgaattatgggggtgggtgtttcccatgctgttcttgtgatagtgagtaagtctcacgagatctgatggttttataatgggcagttcccctgcacacgctctcttgcctgccaccatgtaagacgtgcctttgcttctcctttgccttccaccatgattgtgaggcctccccagccatgtggaattgtgagttcattaaacctctttttctgtataaattacccagcctcaagtatgtatttaatagcagcatgagaacagagtaatactggtggtcagaagctaagatcaaggaggtggacttcaggtcaggtaaatgccaaccatgtagttgagtcagtgacttagaaatctgagcactgccatgtgaactattccttaaaagactctgtcagccagaggttcactatgggttacaatgatcactgagccccattcccaggacttccctcctcctcaactcccatctccctagctctcttctccttacaccagagccatgtaatttgggccagcagtctcatcttggctgcagtcatcaggacctgattccagtcaaaggaaatatatgaacctccgggtcagagctcagggggcttagctttaggctagcacttgattctcatgtctgttgaaaatacaccaaatggcatagtcattatttctttaggggtgtgtctttcctgctagcctgaggctttcctagaagcagtagaataaaagatggaagagaaaaagaaataaaggaatggaaagcgaagaaactgagctggctcctgcttttcctctctttctagaaaccagttttggacactggacctccatcctatttttttttttttttgaatacctgtcttgatagtctgcccagtgagccatgttcttttatccttgatatttttcttttaggacatagaactctaactctaaatttttgccccttttctggggccattagcctttagcacatgcttgattctcactgcaaagtcctggatcccaactctgagctaacatttacctgccctgcccaagggggtctgtatgaaccttcccaacctgatatcataaagctttttcctctctgaaagtctcttttcataaagtttatattcctgccaaggtcttgaccgagaggtctgtggattctaagaaggaaatgctgtagtcaggtggggaggtcatgagaaagatggggtcacagaaatggtggtagcttaataacaggaaaggcagatggaaccatgcctccttcataagggagaacctcacacaaagatgggctttaaaaagttgcaataaacacagaactcagaattaaggtgagaaagagagaaaaagaaaacatgctctgaatataccacatactgagcaacacgaaattattaatacacatattatctcatttcatgttcccatcttcccttgcagtaagagccattatcctcattttcacagatgaggaaactctggctcagagaggttaagaatcttgttcaatatcatcaagcaagtgagggatagaaaacccaggattgaatctgctttgtctgattgtaaagacttttttttccctcctacagatacagatatttagcctagattggaccacccatgcacttctaaggcatacattgttcccaaattagccctacatccccatgatacctatctttcatagtttaagagagaggttactgtcttctcttattgtctggctctgtccatcaggaagttgtagaatcataggatataaaaactgtaagtacatgagtggtctgttggaacagtggtttgtacatttatttgtagcagaattcatgtttggaattcctatacatgaaactgacattgcatgcagcagactcctcagtattcatctgtatctctctggaagggactcttcaggctcttctaaagaccactgcccctccaagaaacacagtctgatgtactctcaccctcattttctcatttgtacatgaggactctggagatcagggtcaagaagggcttgcccaaggttactcaatggaagaacaaggacaagaatctgtatctcgtgctttctattctacacagtggccaagaaatattcatcagggtaaaggaaaaggtatcctggatccatgaaagtaagctatttgggagtgggttgaagatagaagctttcttctggtggaaaataataataatagcacccaacatttattatataccttctgtggtgctaggtacaatgctaggagctttttttgcattattccatttaatcctcttatcagattaggatcccattatgcagataaggaagctaagccttaattcttcagcactaggtgacccagttggtaaatagctttggtggatttgatccctggccatcttgctcgagagcctggctcttagtctgctctactgtcttcctaggaacaggaataataatccagtgaaggctagaagcttgttcatatttaccaacatatccttccctgtcctcctgctaatctcccagcaaatgctctgcaccatcagacatctcattttcctcaccatgactgctaatatgcagggccttcggtataaatgtacaccctctacccagcctccagcaaactcacatgcacccatctacacacatgggcacatgctcatgcataatgcatgggaccaccatcttaaatcctgctaaattgagattcagctagctgtttggtctggagacacctcagtgcctgcgtcattagctgagctctgaaagccatcattactgcagccactgtggctgagtcactgagaccatgagcaggtaatagaatttcagggacacataataaaagggaatggaatgggattcaggtcggaaaagactatctgttatccagtcctgaagggtggatatgtaaacaaggagctccaggcccccaggatggcgattccactgagtccctcagcagaggataataaaaggcccaattacaacctccacactctgagatttcaaaggaaaggaagaaaaaaaatcaatgaaattaatttaatgtggacccattctttatgtttgctttgctagagtagttgtatgagatacctctatagaccagcccatcttttctcacacagtgactttatccacaagaaaggaaggaaggaagaaaggagagagggagagagggagggaggagaggagaagagaggagaggagagagggaggcagatggggaagaagggagggaagaagggaggaaaagaggaaggaaggaaggaaaagaaagggggcaggggaggggaggggaggggatggaagggagggaagggaggaggaagtaagggagggagggagggagggaaagaaggaaggaaggaaggaaggaaggaaggaaaaaggacaggaagggaagggaaggagggtgagagggagggagggagggagaaaggagggaaagaaggaaggaaagaaggaaggaaggaaggaaggggaagggaggaaggaaggagggagggaggaggaaagggggaaggagggaaggaggagggaaggaggagggaaggaagaaaggaaggaagaaaggaaggaaggcaggcaggcaggcaggcaggcaggcaagccaagccttcagacatatttgtttctgacatctcaaaggaggacaaatcagggaatccaaggttggaagagacattcaaatctcatttttcatggcataaaggaaaaggcagcatctctacgtatgattgtgcagcttgtgccctgcataagggtgccccactgaagggagactgggtattgaggtccagtccatggtctaaatggacaagcactaatccttgcatggcttgcatctatacatgtataataagcaggaaggatccaaaggtagagctagctcttctcactaaacaggcaatcagagatctgcattctgtggggtttgtattctatgtgatcttttatgtgtctgctttctagatatattccctcttttgtaaaggaagggttttaggtaaggtacagggtgaggggactatcattaatagagtatggaattcccaccaagcatagtgctgagtataaagcatttgtcttaatcttttcaataatccctttttaggttaattagtcccattttacagatgtaaaaaagcaaggctcagagagttgtgatgggttacctgcctgcaggtcacaaaacacctgagcagagaagccagaattgcaatccaagtgtccgcgcttgaaacctatactcttccctgactatatgcctcctctctaaggctgtttccgctccttgttttctgtgattctatatgtaaaatggccttggttattgaggttttgggggtttgggataagggtggagggcagaggaatatgttgctaccaagtcaagcaacagagaacaacctgacaagagttaatgggtttgtgtaggggaggcaggagcttggagagtgctggcaatgagactgaccaaaaacagaactggtccttctaggaagctaatgagtaagtaatcctgaaaatcactgtccagtaagcctggtgtcaatattgagtaaaataattggacgaatgtgcccagagataatctgtaagcattggaaaaataatggaatagtgagcgataagggacaccagaggttcatgcagaacaaatcattctagacaacttgatagcttttcctgacaaaattacaaaattagtggatgaaggagacatcgtaaaggttctggattttgagctctaacaaaaaattgaatagcatttcttgggatgcctatcttgccaagttaattcaaactgcccctgattcaagctgtgctgtgtgaatttgtgttgttaccaaatctggttggacaatggagccaataggtgctgatgcatggtactgctccaagggtaagggccagagactctcacccctctctctggtctggaaaagaatgtgacagaagggctactgagacccagacaagaaatgcagacatccatacagcagggaaagaccctggggcaccagggggaaggtacattttttagataatttgataatcatatccttcctatggggcaggtgtcatcatctcaccctctgctccattattcacggtcctcgtaattttgcttataaggaactgaaggtcagagtgggagtggcttatcacacagataatgagttgcggcacctaggttgtaacccaggtgtgtctgattccaagaattggtatactctcttctctgaccagtggttctcaagcatcagtttacatcaaaatcacagagagtagacgtggcatgtgaggcggggtgggagacagttgttaaatcactgattactgggacccacccctagggtttctgactccgagggtctggagtggtgactgagaatttgcatttcaccaaactcccaggtgatgctgatgttccaatctaagaccacacctccagaaacactctattccagttccgctcagatattaatgtgcaaataactcacctgaaaatctttttaaaatgcagattctaatttagtgaagttcctgggaaatgaagcaaattgcattactttctcttttttttgttttttgttttgttttgtttttgacatggagtctgttgtcaggctggagtacagtggtgcagtctcggctcactgcaacctccacctcccgggttcaagcaattctcccgcctcagcctcccgagcagctgggactataggtgtgtgccaccacacccagctaatttttatttttatttttagtagagacggggtttcaccatattggccaggctggtcttgaacttctgacctcgtgatctacccaccttggcctcccaaagtgctgggagtaccatgcctggcctgtaaattgcatttctaataagctcccaagtgacgtctatgctgtgggatgttaccacacccaagaagcaaacacttatgccatgatgttgggaaatgagaaatctagaaagatagcactacagttcaagaactgactctggaatccaaaagtagagaaaacagacattataccaaaaaaaatgagctgcaggaaggacataatttggaagatctgagttcaaaatttggtcatgtctttactagctttacaattaggggatttttatttattttattactattatttttacttctttaggtatcagtgtgcttattatttgaggatcaattactaaaaaaaattaaaaagaccatagggaaaatacttgggggcttctcaaaatgattgctgaagataccctccatggtattgctcaacatttcttgtgaggaaagccatgaataaaactgttctcaggatgcagtgctaattagtctctccttcccctgatgactagctatagctccttccacttgcacaaggaacccagtgcacccatccttgtcaaaattttactcgactcagcaccatttatagctgctttattaactcagaattctagaataaaacttgttctaaaaataaagtatacccctctgcattaaatacctcactatatatatgcaatttatcgccacctgtctgaagtcctttaggagaacagagggggcccgaatctaaatgattgattaagtgaatgccaatggaaggagtgtaggctcctcttgagacatctgtgaaactcaagagggagaaatcaaagaggaactatcgcatactgttaggtacagtcagaatgtaatggctaattactattatgattgtgattattatacagtaaaaagcaattacactttaaacttgatgtttaagaaacctgtaacaaatacaactctaccccatgtaattttccaaactcaatcaattcctaccactctccccatatctctgtgtgccctcctgttatggtctgtccccaaaactcatgtgttgcaaatttaatccccattgcaacagtgttgcagggtggggtcttttggtaggtgtttgggtcataaaggctccactctcattaataaattcaagcctttataagagagcttaacagagggggtttggtcccttttttccccttctgtcccttttgccaggtgaggacacagcatccctttcttccagagaacacagcaacaaggcaccatctcagaaaagagaccaagcccctcaccagacactgaacctacctgtgcttttattttggacttcccagcctccaggagcatgaaaaaataaatatctattctttataaattacccagtctcagatattttttttttttatagcaacacagacacctccctacatcacctgtttcctggagcattccctgacctttcacctttgagttcccccgacagggcctatctaccacaaagaaaattctaaacattgacttatttcttaaggttcctcaaactccaggaaagtcttctctagtattgctaatttcccttctttttctgttcattttctcagagtaacataaatttccccaaagccatgtgttgtgtatggctctccatggccaatatcaggtcaaggctccttccatgtccacctgggtcaataattaatttattcattcatctccattttcattcattttttaaattcccccctggtctcagcctttccttcaactatttcaccactcattaatcacttcactaatccattcatagaatcaatcatttacacacttattatctacatattaattatatattcatgtttatgtatcaatctgctgagtagtttatttgattttcattcacacatcaattctctcatcacacattcattcactcacccactcattcattcattgaacaactacaacagtcactgggtgctcactctgtcagaatctaacttgagtactgattctagaagatataatctctgctcttgagaaattcacaaaccagccaagaggacaaagaagcaaacggtagaataccaaattctgtgtggccagggtggagcagaagagaacaggaggttgaaaagaaaaataagtaataataactgcacacctactgtgtgctcactgcttcatatgcattatctgatttaaatgcacctttctctttaataggtaatgaaaccaaatttgctcactgaatggacttagctgaaatctaagtctaggcgttctcattctgctccccatgctcttaaccactctgctgtattcaccgtaatataatcagcgaccttggtttaggattagcatttctggggaacagtgtgggagcaatcaaatttgaaaggtgtgagaagcaattggaaagtgaggaagtgaagacagtaagtttctatcacgcagtttgtccttccaggggagaagagagaaggctgtaactgaagggggcttaggattgagcaccagacagcagaagaacctcatgaccctgggcaagcgtatctatcatagtagctttcctcattcttttccgttagttctcttcatttccatttccccctacacaaccaagagctattttatttacttttgtatatactaggacttagaatagggcctgtcatagcatagttgataaattaatatacatgaatgagtgaatgaatgaatgaatgtcaaattctttttttttttttgagatggtgttttgctcttgttacccaggctggagtgcaatggcgcgatcttggctcactgcaacttccgcctcctgggttcaagtgattctcctgcctcagcctcccaagtagctgggattacaggcatgtgccaccccgcctggctaatttttgtatttttagtagagacggggtttctccatgttggtcaggctggtctcgaactcctgacctcaggtgatccgcccacctcggcctcccaaagtgttgggattacatgagccaccctgcctggccatgtcaaattctttaaaatggattcacacattgcctagagttctattttgcagaaaggagggagaagtaggtcagctgactggagctttctacaaaacagcccatggaacaggccttgtcttggaaagatggtgatgcagacagagtgactatgataaccaaaaaataaactaaatcaacattgacaaggaaaatgtaaattcagaaacagggaaaaactgaattcaagcgctagtggtggacaggaccaaagttgaggacacaagtaggcatataggatgttcttaaagcagacaggaaattggccctagaaaactcagacctggggggcaaatgtcacatgcctatatcatttggatgtttgcacaatttcctggcaatttgtgtcggtccacaagcccagcagagaaaagtcttacgggtgtggagaaaatgaaggttttagcttcagtggggtgggtttaattagaactgttattagtctgttgtgcaaaaagctcattagaaactcactggggctctcaaaagtgttggacatttttttataattacatttcttctgattcctccatgggtttcttgatgcagtctgagcattggatctattaaaggtgtgtagggaagaatgacttccggttaacttgtcatttcagtccagggccagatacctgcagttcttgccccacatattgttgaaaagaagaaaggaatctgaaagctggtgaactgtagcaggttctttgacatgtgttattttatatcacaacaagcagaggaactggatgttcagatacctcgagcagctttcacaaatttacacagctagttagtggcagcatcagcattcaaaccccagttggtctaactccaaaacccatactctttccagagccccatgctgcctccgacagtgagacttcttttgtaagagaaaagatttctcacttcagtttggcaactacagtttggggaagggagagaaagtgtgggcagggtagcaaagggagagaggaaaaaatcataccatgccagtttcagactcaaagatcactctctagctgtcagtggagcccacaatcactgtggagttttattaaaaagcaagagttgtagaagaatgaagcgacagatttaaaattaacttgccaaactccccatcaatattatgacagtccccaagtaccagttcagcgacccagtgcaccaacttgacaatattaacataactttgttggaacaaaagcttctcgaactctgtcttttcaagtgaagctaattttgaggagacagccattcttctttctgccttttttggcacctctgtgacaggtccccctggcccaacctaagagtgcatgttttataaacttctattatcctttcacctccctggggactgccacccactctggatgcttaagtcaagtagagcagtacttcttccacttagggacgtactgaatgaatgaaggctgggaaagagatctgcatacttgccactttctgaacactgacttgggttccctttggtctttatatttggaatgaagatccgtgatggctaacccaaccaaaattcacatttagggcaatgtgctctctgtaccagcttttataagctaactgcagtctgattccctctttttcttcacctaacaatctcttacttacccttcacatctcagcttagacattaatttcatctacctggagtcctacaccccatgtgggcttgccctggtagcactctgactttcatacctaacactgcacgggtcagtttatcgaatttcactcactaagtatctttcttttgttagtgtatgagttcagtaggtagagtgactacataatttatcatgtgatccaggggacttttgtctaggatatacgctaaactggagaggactttggacaacagtcaaactagactgtcctagtaaaactaggatatatgagcaccctccacagatgggcatatatcgcaactgtcaggctttctgcgtctctatcacctcgaacagtggttaaaattttagtcagtgtagcatattttttgaatgaatgaatgtataaaacagttccttttttttttaaacaagtctcacaggcaaactcataaaatctttccttccttccttccttccttccttccttccttcctccctccctccctccctctctccctctatctctctttccctccctccctccctctctctctccttgtcattcttccctcctttcaaccttctatcttgttaacgacctaccacgcaccaagccctgttcactctaattactgggcatacaaataaacatggctctgtcttgggagtgagaaggagaaacaattagcatgtagtgagcatctactatgcatctgttgctttaaacattgtatattattaatatatatccaactattcagtgaggtagttaatatgttcacctagacaatgaagcatagagacaggtcaggtgacttggccaaggtcacacagctaatagcagcagaggttgaattcaatttcaggtctgccagagtacaaagctgtggtctcatctctaaactaagctactgcctaaactgtgtagaaggaaggcgaaatatagggcagtacagggtgtaaagagctatgggctgaggaggttcctaatacatgagcacagaagcttctctaacccacaaaatcttatgctctttatcgatggacataagaaaaatccatctctaacttacagctaccatttgttgagaacttagttgtatagatactttgctaggtcttggaaatttataataatgaagagtcaagagtcaagttaagcaggggaggtaaatatcaaataataatacaaatattaattttatttttcacaggtatttcagagaaaaaaatagtatgaggaccatatagtatgagacacagtattttttaatcactattttcacagataagaaaaatgaagcttgaatggataaatggatcaagactgcactctacagagctaggatttgaacccacatctacttagctccgaagtctgtattgtgtttacttccccacttttctcctgaacaattcaatcataacacccctaatgaaacagagcaaatccttcaccactacttttcatgctctttaaacctcaaagtttttacatgcagaacagatataacactggctcttctctgtaagcttgttgtggcaattaaagaaaagacagcacttgaagcaccttgcagagtgcctggtccacagacatgttcagtaaatagcaaatattgtcatcattaatattattagacagtattgaattattgactaaggtcatgtggtgctccatcacacacgcaatgtcctgtgttgttagttaactttaacatgggcatgttttcatggcattctcccattcccctattgtccccacctttgagtccctcagcctagcactgtgatatgaatggagcagaatgtgtgaccaaccaagtgttaaaagaggagagaggctgtgttggggggctcatgcctgtaatcccagcactttgggaagttgaggtgggtgaatcacctgaagttgggagttcgagaccagcctgaccaacatggagaaaccctgtctctactgaaaatacaaaagtagacaggcgtggtgccgcatgcctgtgatcccagttactcgggaggctgaagcaggagaatcacttgaaccagggaggtggaggttgcggtgagctgagattgcaccattgcactccagcctgggcaacaagagtgaaactccgcctcaaaaaaaaaaaaaaaaaaaaataagaggagcaagaaatggatatttgaatatggatttggagccagactgtctggattccaatcctgtctccatcctttaccagccaaatgacaatgagaaaattattcagtctcttaacaattcagtgtcatcatctgttaaaaaataagggaggggaaaaggttgacagctcctctaggtgtctgtagaactgaatgcgtttggacagtgaagctgctgcctgggtctcttcttgtgtcactgggagctcatcctcagtctcctttgctggtggctcttcacctctccgatgttaaactgcaggactcagggctcaggctcctctcttctctatctactccctagtgagtttgtgtcctctcatttcttttctgtcatctacatgctaaataatctgaaatgtacatttcaagtcatgtttctcttctgaactggtatatcctactggcttcctgacatcaccataagaatatatattagacatggccagatgatggctattgacgccggatgatgagtgcctggggttccatcacactatggtctacttgtataaatgattgcaatgtttcacaatcaagttcatcttttaacattatcaaaaacaaatttctctttctattcccctcccttgtgcctgctcctcctgtgggctttcctgtctccatcaatggcacatccgtctgtccaactgctcaggcaaaattcagggcactaaccttgcctccctcctttctctccctcatcagtaaatctagttgtcccaccttcagaatacatacagaatctgcccacctctctccatgctgacttgtctgaacatgctccaatccacagtcgtctgacatctggaccacagaagtagcctgggaactgctttccctgatttcaccctgcccactaacgtctattcttcacaccccagtcagattatagaccttttctgctcaaataatgcactagcttggtttccttctcactcagagtaaaattcaagctactgcatttaggagtcccacaggaccctatacaaaatggcccatacttccccagttggtacccattgcctctttatttgtaaccttttttcctactacttgccccgcctccttcccctctgttctatccaccgaggctccttttggtccacagaaaatgccaagggtctttgaactcggtgtgccttctacctggaagctgttccccagatatgtgcatagttcactgccttgtttcagatctttatacaaacgtcaccttgtcaagtaagtcttccagcctgtaaaacatagaatcccctgcctaaaaccctctagtacccttaactcaacctgcttttctccacagtgtatgtacctgacagggtgtatatttatttgttgattgtcccctacactagaatataaaccttcagagcaggggtttttatatattttgttcactattgtcttcctggtttcctagaacagtcagtgtcatagaataagtgctcaaaaaatatttttgatagagtgaagatacaatagtgtctggtgcagtgtgtcattgttatctggttactcttattactacaatcactactgttacttgttactcttgttactacaatcactactacctaaatactggagagatacccaagaaactaataaaaatgggggataggggaaaaggatagaaaaaaaactgagaaaggagtgacattcctcattgaatgtcttttatactgtttgtgtttttaaactttgtaactttaatgcctgtaaagaaatcagtttaaaaatatgctgatatggtttggctgtgtccccactgaaatctcatcttgaattgtggttcccattatctccatgggtcctgggagagaccaggtgaagataattgagtcatgggtcctgggagagaccaggtgaagataattgagtcatgggggccatttcccccatcctgttctcataatagtcagtcagttctaaagagagctggtggttttaaaaggggcttcccctttcactggacactcattctctttcctgctgccctgtgaagacgtagcttccgccatgactgtaagtttcttaaggcctccccagccatggggaactgtgagtccattaaacctctttcctttacaaaatacccagtcttgggtatgtccttacagtagcatgagaatgaactaatacatatgcctaccaaactgtcgcagccaagcggagctaaggagatggacaactcagtgtgagatggtgaccaagatgctcttaagcttcccatcagcttgactaaacaccaggcaggcttctccagtctctagatccctgacctgccttttcttaaagcatttactttagaaacttgcaattgtaaattctttctctgcccctttaagacataaatcttttataaagtttcttgccagttttacaatctaggactgtctttctcaaggacgtgggagctatttctttgaaatgtaatcatcaaggaagacagtacccctatctcttagtctttgtggaagggtggaagcccaacttccatggacaccaattagcaaacacagatggcctaatcacagagaaatacatttgcaaagtcaagaataactcaatgtgctggacatatcctattgttcaatctcctaatgtcctccagtacttttccacttactccagcaattaaaaaccctcctgtccttttcagtttcagtgaaattgagttcagacctctctccttcctctattgcaatagccttgaataaagtctttcttgcctgtttaacatcatccagtgtcattttgctttgatgtctgtatgctgaatgggctcctgtatcagaaaaaggacatcagataaaaactaaggaaatctgaataaagtatgaactttaggtaataataatgtatcaatattgatttattaattataacaaatgtaccataaaaatataagaggatgctatgggaaactgattgcagggtatatggaaactctctgtactatctttgtggtttatctataaatctaaaactgtttaaaataaaaaaatatatttttaaaatcctatctgaacctggaggacatcatgctaagtgaaataagccaaacacagaaagacaaatactgcatgttctcacttgtatgtggaatctaaaaagtcaaactcgtattagagagtagaatggtggttatcagaggcagggggtgggaagaagatgaggaattgcggggagatgaagaatagggagagattggtcaaagggtacaatgtttcgattagacaggaggagcaagttttagtccattgctcagtgtggtgaccatcgttaataatggattatatatttcaaaaatttgctttgaaaagttttttaatattctcatcacaaaaagtatgtgagatgatgaacatgtttattagcttgatttaatcattccacagtgagcacatatgtcaaaacatcacattctatctcataaatatatagaagtagtatttgtacattaaaatatatattaaaaataaccctatctgagtggaatacggaaaagaacatccaagtgtcagaaagatccagtaagtaaggctctgacaccagctatgtgatgacagtcaagtcatcagatctctttgagacccagttacctcatttataaaatgacacttgcaaatccactaacatcatgcattctcagtagtcgcagaaattgtcttagacaatacaatggcttgtggtcctccaatgtctaactctacccaataaaactgtgacccttagtatttaatttctctcattaagaagaattcaatcctattttttttctatgacaaggggtgacagtaaaaaacaagtttgaacacagccttagataatacaaaaaataaaaaagtatattactttccctttacaccaacattagaccgagttttgttcagcctgaatccccagaacctgtcacataataagctcttgatgtgtactgattggctggagcacaaagctgaagcaaatttaattgcaatttagcttaattctcaagctgtgtttccaccttctttgcaaatacagctgcaaaatgcctatatggtctctgggcttgtttattcccagtggctgggtcctcactaactcctaagaagtagggaattaatcgaaacttacagggatatcctttagagcaactttagttctctgaaccacggcatgacaagtaagaacaatcacttcatcgtctttctttcctcctacactagaaagcatcaaaaagaaagggaagcagcctcaaggtcactgggaactcagtaaagaatgaagaggctgactcagggtttaaggttctttcaaagtcctcaggcatacaatgaattaaccagccctgggctactcaaatgcctgtagctttgactcctggcttgtgcctgctaattaactgtccacttaatgggctcctctgaggatctcaggcaacataaaaaaataaatgctcattttggactcttaaaagccacctttgaggtgttccactagattatcattaatagtaattattcagtagtgatgttacataaaaccccagccactgcccttggagctttctgtataaattcacatccaataaactgtgatcatatctttcattagaactgttactacatacatttcaattcagggcatctctttgaaataaaactatttccttaaaagttaattttcttgatacacatgtgtgggcttattaatgtgaccttagaatagacttactgtttcatttatctggaaggaatacaaagaaagtaatgctggcaaatttgcatctcacatgatttcaagtgtgacaggacgcacactacaacacaattttggagtaagtggtatctcacagatccctggattcatgttgaggaaaatgtcactaatactcccacatctttacaaggcatcttaacctgacttttctctttctctttttttttttttttttttttttgagatagagtcttactctgtcacccaggctagagtgcagtggcgtggtcttggctcactgcaacatctgcctccctggttcaagcgattctcctgcctcagcctcccgagtagtttggattacaggcactcacaaccacacccagctaatttttgtgtttttagtaaagactgggtttcaccatgttggccaggctggtcttgaactcctgacctcagatgatctgcctgcctcggcctcccaaagtgctgggattgcaggcgtgagcccccacacccggcctacccttacttttctcatcacctctttctcctcttcataattctcctgtgaggcaggcactgttatgttccctgacttcatggtgagaaaactgaggcttagaaaggcaattagaaggtgcaaggtcttacagctagtaatggccccctttggtgcttacatagcctttcctgttggaatgtccatcctccgccctggcttccttacctctgcaatcccatccctccaccccttcatgacccaccttgactttcacgtctgcagaccctctttgttctcatttgcctggaacactccctcacatgctaactgttactctagcctccaggtctcaggaagcacttcttccagggagtcttcgctgcctctcactgagcaaaatgcacttgatgagtagtccttctgcacaagaatagggacgtcaactgtcttcttctctttatctccagagattttttttttttttttgagatggagtctcactctgtcacccaggctggagtgcagtggtgtgatctcggctcactgcacctctgcctcccaggttcaagcgattctcctgcctcagcctcccgagtagctgggattacaggcatgcgccaccacgctgggctaattcttgtatttttactagagacggggtttcaccatattgaaaagaaaggaaaaagaggaaagaaagaaagagaaagaaaggaaggaatgaaagaaagaaagaaagaaagaaagaaaagaaagaaggaaagaaagaaagaaagaaagaaagaaagaaagaaagaaagaaagaaagaaagaaagaaagaaagaaagaaagaaagaaaagaaaagaaagaaagaaggaaaggtctcaaactcctggcctctagtgatccacctgcctaggcctcccaaagtgctgggattacaggcgtgagccaccgcacccagccctatctccagagatttataagacctgatatataacagatgttcaataaaaactcgttaactcacaaatgagaactagtggtaaagccagggctagaacttctgacctcaagttcatttctgtcatcatcttattccctcttataattaataaaacaataacagtaacaaatgacttctgaggtgtgatttctttcttgagtgagataccaatgtggattgaccataatgtaatacagtaaaatttcagtactgtggactccattaagaatgcataatgccttgaccagcagctgggctggctcataccttagaagtgtttatttataaaagagattgctaagcacattagtgcattagcagtgtaaacaagatcatgggggaaatggcagaagacacttaagagaacaaactgcctggagtcactttggaagcagccattatgaacaaacaatcactgtgctaattacaattgctctgctaattacaattactgtgctaattacaatctaaccttatctgttcataggttccctaaggacttttctttctgagcgtttagaccagcctgagttacggcctgcatttgagtgtaatgaaattgcgcttctttaaaaattgtctctgcttcagatgtctcagtgattcagataggctttccccttctagaaaaagaacacagtcagggattttgaagccagaaatttaaaacaaaaccaaaaaaggggggaaagcgagctgtgaagacaagcaaaatggatcttgttgattttgttgttttagcacctcttgcagtctagagacacatttttaggttagttggagaacatttgaaatatactctgtataatttgttttcttcataaaatgaccaggtttggtatatttagagatgttaacattgagaaaattttaaaaaattaaagtggctatttttctttcctctcttaccataaatacggggaaagattacagagggcttgtttaaaaatggatcccaattccctgctccccattaaaaaaataataataataaagaacatctttcactagatcttaattttactacttactttctatccccagtcaaactaatgggtgttgatgctatgagatttttgtttcagcgcttaagaataataaagcttcacccaggccaatgtcttctcctaaatggatttctcgctactcttccaggagtttgtcttcaacctttgacctgaagcagaatgcagcccagcactctgctggtaagtagctttctgctgcatccaattatggctgaaattgcagcgtgggcacatagaggaggctctaatccaggcacccaaccgtggcttcagcacctgggacttagcagcctgccttcaataagtgccttctctgttggcactgatctctaagcatccctgtgcccatcagatagcagagcggatgaacacaaaataacctttgctacattatgcaccgggggcctattggattgcaggagaggtctgtctcccctggctgctgcaaaactgaaacatattctctgcacttggtcactctagagaggattatacgcagaagacttctttaagattccatggatctctagtgccattggccttgggacttggttcctgctttcaaactggcaaatggaggaacaacaattcttcattctcaggcataacctaggcagctcgtgtttccatctagcatttaagttcagtttaacactttgctattcaaagctgttcctctgtactcatggacataaagatgggaatagcagaaactggggactactgaggggggaaggagaaaggggacaagggttaaaaactgaatattgggtactatgctcagcacatgagtaaagggatcattcattgcccaaacctcaggatcatgcaatatacccaggtaaaaaacctgcacatgtaccccctgaatctcaaagttgaaaaaaaaatttaaaaagagaaacaaacaaaaaataataaaataaaacacacataacaattaacccaatcattctattcctaggaatttgtcctacggatatattagtatgctcagacatatatacataaaattgttcactgaaatacgttttggaaaagccaaaaactggaagcaacctagatgtgcatgaataaaggagtggttaataattatatgattcaatcattcaacacatattcagcaggaacgggggacacagcaatgaacaacacagacagaaatccctgccctcatggagcatatgttatccctacagtggaaaaatatggtatgcctgaaacgtaggaggaagatctataaacattgatagctctccaagagctatgagtaagtgaaaaactcaaggtgcagaacagtatggctggctatctagctagctagatatttagatcatatgatcccacttggaaacacatattttaatttgtttaaaattctggtgaatacaaaaggaacttaacggtcctttgggaaatgggattgaggtccagaaaaaacagaatcttaaatatgtttgaaaaacaaacaaaaaagctggtccttggacccagcagctaatttgaaatacagagcctcagaatttattacctgtggcctactgatgcataatctatattttagcaggcaattggtttgtaccttagagtttgagaagcactggcataattcatgtgtattgagttctgactttaagcagatatatggaaaattcccacctttagatagggttttcatgcataataatgatgagctattatttgcttcccagctcttagaggatcatatggtttggaccaggagtgtccaattttttggcttccctgggccatgttggaagaagaaagaatggttttgagccacacatcaaatacactaacatcaataatagctgatatgcaaaacaaaacaaaacaaaacaaaaataaacaccttttttttttttttttttgagatggggtttcactcttgttgcccaagctggagtgcaatggtgcaatctcggttcaccaaaacctccacctcccaggttcaagtgattctcctgcctcagccttcccgagtagctgggattacaggcaggcgccaccaagcccggctaattttgtatttttagtagagatgggatttctccatgttggtcaggctggtctcgaactcctgacctcaggtgatccacccacttcggcctcccaaagtgctgggattacaggcgtgagccaccgagccgggccaaaaacctcataatatttgaagaaagtctacaaatttgcattaggccacattcaaagccatcctgagccacatatggcttgcaggctgtgggttggatgagcttggtttagaccatgtgcatgtgcctgagcacacatgttatctagaggccatggagtgtttagaagagcagcccttcaatcctggctccattatttacacgctgtgtggccttgaatgccatgcttcctctctctgggcttcaattttctcatgtaaagcgtatgagcatcaatctgctttgtcaacatgtgtcatgggagaaatatctgcctatgcccctcaaacacaggctttgaaagggatagaaaacagttttacaagatgggttatgctttaagggtattgggaaatgaacagaggatgtgatgtggtgataataggggaagaaaattaggacaggtagtaggtgagcgagactgatgtgcagtccagcaaggcttgctggttaagctttatgctgtttgaaagggcctcctttcctattgggcaagtggcacttctatgcttatcgttaaatgtttttgtttttgtttttttgtttgcttggttttttcagatggagtttcactcttgttgcccaggctagagtgcaatggtgcaatctcggcttactgcaatctccgcctcctgggttcaagtgattctctggcctcagcctcccatgtagctgggattacaggcacctgtcaccacacccagctcattttttttgtatttttaatagagacgtggtttcaccatgttggccaggctggtctcgaactcctgacctcgtgatccacccgcctcggcttcccaaagtgctgggattacaggcgtgagccactgcacccggccttatcagtaaatatttttaatatcaccctagaggtgggagattagcacaccactgcaacttttggatctgggcccaggccctttatcaaattccacatagtaaatatgaacacttaaatcccacattcctaataagatgtgtttcattacagaatgttcagacagaaaaaaaaggatgtccctataagggacaggtgacagaacacactggagagattatgttttcccgaggctgtgattccacactgctagctgagctgtccacttcccatgaccctcacccccagagcatgaagggctgagcttctgcccctatcctgggcatttgatgaaagcaccatgtttaccaaaacatgagctgcttagaagaagttgagaggataaccctggctccagtccagaaataagttttgcagggaatgaaaaaaaacccatcttcatctgctgtatggctcctggaactggggggaaaggaatgcaatttaaggcagagaaaggaatggttattgggatcctactgtgtgctgggagctttgcttatttgcctgttaaatccttgccaaagctcttcagggttattttaaggtaaaacaccactttatagttgaagatcttgagattactgaagttaagaaatttatccaaagccacacagcttggaaagggcagacacgggatttggaccctgttagtttttaacagcagcacaccagccaggaagaggatctagtccctgcataatcctgcacatgcaagtgagctttgcttacagctcctccttagtgatgaacctggcagccctctatggcacgtgggacttctgtctgccaaggacagatatgaaacaggttccaattccatttaattatctcaacaccaggaagtgggcattgttactattattcttaatttagggatgggggaaattgaggcttaatgaaataatgtgtctatagtcacacagttggccaagctgggactctgagtccagagctggcctcttaaatacaaagtcattgtatcccaaaattgttggatcatgtgaaccacttggaaatactggtaaaaattcgctttcccgaatcccttttctgggaaaaatggtgggtcttggtgcagccccacgtgattcttatgatcaggtgaataggaaaagcttccctaagctcctggccataggagttgagtagcaaaaatgctatgttttgtgtcagatgctctcagcctctatctgatatttgcattagccttaatttacagaagaggccacagaaaccagggagaagaatggccaagggtgatacagcaggaaatggcagagcagtatcagaaactcataggagcagagagtagaattgcagttgtcaggaactgggtgaagggaaaaatggggaggcaaggactaaagggcacaaagttttgggaacagttttattatgcaagataaataagttctggagatctattacatagtatagtccccatagctaacaatactgtattgtagactcaaatttcactaagatatgttaaatgttttgttttgttttttgagacaggatctcacagtgtcacccaggctggaatgcagtggtgccatcatggctcacggcagccttaaattcctgggctctagtgatcctcccacctcagcctctcaagtagctgtgactactgctgcacaacaccatgttcagctaacttaatttttcttttttttttttgtagatatgtgatatcactataatcctcagactagtcttgaactcctggcctcaagcaatcttcccatcttggcctcccaaaatgctgggtgttaaatgttcttagcataaaaatctaaataaacaaagagggtgggagaaaactatggaaggtaatggatctatctatggccttgacggtggtgatggattcactagtatatacttatctccaaactaatcaagttgtgcacattagataagaacagctttttatatgtcaattatactttaataaagtggtttgaaaaaagaaagttagctttctgattccagcccctatgctacacccaacactggtcttgattcctgcagaagatgtcagaaaaccttggaaacatggagccacacaaaagaaaagaggtttttttttctgcaaccagttcaggagtcagaatgccaggaaaattcaccccttgactcctctaatccagcctccaactgctgtcctcagtgcacttctaagatcttgccaatggtccctcaaagaaggcagcaaagtgctatgtttccaagtgacaagttgaggattttgctaagagcttgaatactgcagaatattgctccatagagaggcttgggaatagccttgaaaatcagaagctaatgcctccttttaattaatgctgtctctactaacagcctcttttgctttttcttatttcaatgagatcatcgtctattataaagcacacagacctgagagtgcacaaacacaactttccaggcctggttctgccactaattctctatgggaccttggcattggtgctcctgtacagtgtcagggttggatgccatgtctccaaggcttcagacagaatatagtgcagacaaacagactgagcattgaaggactggcttattcatttattagtgatacaattttaggcaatttacttaaccactgtgagcctcaggtatcccatctacaaaaggggagagtttagccaggtgcagtgactcacatctgtaactacagcactttgggaggctgaggtggaaggatcacttgaggccaggagttcaagaccagcctggccaacatggtgaaaccttgtctctactaaagatacaaaaactagctgggcatggtggcgcacgcctgtaatcccagctactctggaggctgaggcaggagaatcaggtcagcccaggaggcataggttgcagtgagccaagatcatgccactgcacgccagcctgggcgacagagcaaggttctgtcccagacagacaaacaaacaaaagaggagagtttgttcaaattgttctgcaaggcttttccagctataaattttgtggttcttcagtaactgaaagaaagaaattgacaagagaatagaatgatgtagtatagttctcagaggctgcaatatgaaacaggagagtgctgggagccttgaaggcatgactgttaagtgaactttggtgttaaacccagatgctaccactttagctgtttgactgctaggctagttagcctaatctgtctgtgcttcagtgtcccacaaatatgtctgtgcctttgcttctcagtgtcttacaatgtgctgagataagacagcatgtcttatcgtaagatgcatcataagatagcatgtctctgtccaatcctttgagatagcaatgggacttaatttgaccagaaatagaagcagaatttcactgctaggagaaagttatgatagccaagtttgtttctcactatgaaagcattaatggaagcacagaaaggtgattcttctgtcagtccagatttccgaacaccagaatggccagggcccctgccattcagggagaggcaggtggtatgaccaacacataaaaactttcacagtcaggccactgaagtttgaaattgtttgttcccaagacacaaacgaatgcattctgactgatacattcatttccttttattcataaagccaagttgttaatggctcctttgcaataggtgtgaaaatatcaaatgaaaaaacacataaagtattcagcataggtccagacacataaaaaatgtacacaccattaaaggggcggggggagggaaagaggtggaagggaggggaaagaaggtttcagaagcagcatgtttaattaatcacctcttaggaaggcactagaaaaatcataggccacaacagctttggagaccacttaataagaactgactcagtatcctcagtgggggaatgagtgagtgctactaacaaacaccagctttccttgaatccttatagaaagcccttcagtcttgccaagcgtgggttgtgggtgctgaatccccaaatcccacatcttaccccaaactgtcctcttatgctatacaatatgcacatctgataagcagacaagattgaaaagtccctttctaataaatctctcatgagctcctccagctctttgcaggtcattcttgagggcctattggcaaatgcctactgccagcagacccatcttatttatgatgaggcttttgcaaaatctaccactgtaatttgctcagtccccattcccaagcagcttttccttcctgtcatttctgagacaccaggttcaataatagctcttgactgatgtttatctaaatctctgcaatctataaccaaagtttacctttcttccttataggaatgaagtagaatgaatgtgggtaagagagtggggggggggagaataaaaaacaaacaaataaacatcaaataccaccaatctttggtgagtttatctcacttgaatagtctgtcaattcccacactgatcaagagcaaaggaaaggggattctgacagtgaccctacatggatcactgagaccaacacttagcaccggaagggataagaaacaacaaagcttgacatcacttaatggatttgggggcaatttggaagtgaaatcattggctcttcacatttccacagaacttgacattttaccaaaggcttcattcatgtcaatttcaacataattcctaatccagtggtctctctcagcaccatccagtctctcaaaacaagccccattcccttccgaggaataaactgtattttgatttttgtatgaactgtgtccttctttcttgatcttttcatgtctccttcagtccttccgtcttgcacacatttcccccttccccgccttctgctgtctgtctctgtacctccttaactctgttcactgctctacatctcttcttaattctttctttgcttgctgttccctcctgctgtgacatagactgttctttagtgtctcctctgtttttgtctctttctccctgcctctgctcggtctgactgagtctccttgtcactcttgccctgtctttatctttccatgtgaatctcttaatgtgcaccatgcttaatttttgcacacagtgcaaacccttggactgttcaggaaatatcaccacatgctcgccccccagaacaggctgtagcctacatgcagtgacctgaagaggtagctccccatggagtggtctttgcctaagatccctccttagttataaatttggtctccccctgtggcacctgggtcctcactctacactgagaacagggatagaacacatggctctcctcatcacatgctgatatgggatataaagtagttgcatacatcctttattgcagaacaagaaaccagggagcactggtttgggagtcagaagctaactttcagcatgagaggagttccaatcactgtgaatattgagccagttatattatttcctgagcttccgtttctccatctgtacaagtaaggtctgaaatagttaatctttaagttcttgtctagttcagagacattacatttttaagcgctttgtaaagcagaaatctgggttgctctttcagagattcaagagaggaaatgaaaacacagacctctcttatatcagcagttgctaggtggggtgatctaggcaggggcagggaggagtacaaagcagaactgcagctgtcacacaggagacactagctggtagagagtttgatatcctaggccagccaattgtcaggaaatgaggcatatggtgagacggctggtggcagtacttgctggctactctctagggctggaccagagattacttagaggagggaggaaaggaagtagtaggaggagagaaatgacaactgcatttgatgctgaaatatttgcaggctttcaggaatgtgaaggacaaaggagctccatcctccctgctgtctggagctcaggaagggagacttgaaaaagataaatttacggctgggcggggtggctcacgcctgtaatcccagcactttgggaggccaaggggggtggatcgcgaggtcaggagtttgagaccagtctggctaacacagcgaaaccccgtctctactaaaaatacaaaaaattagccaggtgtggtgtgtgcctgtaatcccagctacttgggaggctgaggcaggagaatcgcgtgaacctgggaggtggaggttacagtgagccaagatcatgtcactgcactccacattccagcccaggcaacagtgtgaggctctgtctcaaaaaaaaaaaaaaaaaaaaaaaaaaaagaaagaaagaaaaagaaagaaagaaaagaaaaaaaggaaaagataaatttagacccatcagaagtggcttgcctttccacagtggggaggcaactgacttagcatggttccaagaggatacatggtctggagatggaaataattgcaaagaaagtttagctgaagccaaggacgacagagcttaaatggaatagattgctctaatataatggtggtagtcttgggagttttctaaatcttgagggtcatcaaaagagaaaatcctggtctgttcactgtactcccctccatgggcaaatcagggcacttaggctctggctgttcagaggcaatccagggttgagaagttggaaacaattagcagagtatttgaggcagaacaatgacttctaatggacctaaaattgtgtctgggactggacagtcagtcctaggccagcctttaaggggccatgttctttctttctttctttttttttttttttttttttttgacatggagtcttgctctgtctcccaggctggagtgcagtaccactataggctcactgcaagctccgcctcccgggtttacgcccttctcctgcctcagcctcctaagtagctgggacaacaggcagccgccaccacgcccggctaattttttgtatttttagtagagacagcatttcatcatgttagccaggatggtctcaatctcctgacctcatgatctgcccgcctcagcctcccaaagtgctgggatgacaggcatgagccaccacaaccagcggtgccatgctctttctcactgacgagtctgttggccgtgggaagataagcactccaagcagtcaggagaactgagaacgtgggctggtcccacaatgacttgctttgtgaccaagtcctttccctgcatgtaaaatgagatcccaggatttaatgaagtttgttcaggatctagcctcttactacccatgtggatccttcttttggaccaagctatccttcacacaacagaatggtacattggctcaattatcaaatgccagccactctgagagctgctgtgagaaatgaaactccataaaacatacaatgtacctatggaaatggctggcttctgttaaaagcaccccattttaaagatgaagcagtagaattatgcttctcatgggtggggctgggatttgaaggcatgttcattggcagtctgttttcttgactcccacccttgcttatccatatgtctgggcctttgcaggctccttcctggacaggaaaatgccctttaactcttatctgtcccaagaggcactattctttgctatcacttcaaacctcagttcacaaactttgtcctttgagaagccctttatctttccttctaattcctttcaacaggcttccatgggaactctttggaaaccatcgtctttccttggaacactgctttgcaaattaaatttttctatttttttaaaacttgtgtgtgtcatcttgcaagcttttaaatttcttcctcaaagagaaggaataattcctttatttttttattttgtattccaagcaacattattctatccatgatgttgctcaagacacactttcatagaccattaaaattatagaaaactagtattgtagaatctcagcattgaactgcaattcatccagactatccttaaatttttcccagagcttttcctgatttttgttctttttttttttttaaatagagacaagtgttcactctgttgcccagactggattgcagtggcatgatcatagctcactgtaaccttgaatggccaggctcaagtgatggtcctgcttcagcctcccaagtagctgggactacagacatgtaccaccaagttcgaataatatatatatatatatatatatatatatatatatatatatatttttttttttttttttttttagacggagtctcactctgtcatccaggctggagtgcagtggcgtaatctcagctcactgcaagctccgcctcctgggttcatgctattctcctgcctcagcctcctgagtagctgggactacaggcgcctgccactacgcctggctatttttttgtatttttagtagcgatggggtttcattgtgttagccaggatggtctcaatctccttacctcatgatccgcctgcctcagcctcccaaagtgctgggattacaggtgtgagccaccacacccagcccagtttaaaaaaaaaaaaagttagcagagatggagtcttgcaaagttacctaggctgttctcaaactcctgggctcaagtgatcctcccacctaggcctcccacaagtgttggaattacaggtgtgagccaccatgcctggctcggagcttttccagtaaagtagcattcagtctctgcttgagcaactgagtcatggatccacctgccaacgatacctaaagtgtcagaggggccatttctatctccttttccatcttatgcccaataaccagcatggtatatgagaaagaggagattctcaaagagtatatgatgattacaaggatgaacggttttagtgaattcacatctccattctcattctgtaaaatgggagtaagagggtatgctgaattgaaatacaagagcaaggttttagagtcagctggagttacatctgattcctgactctacctcttactagatgatgatcttgagaaagtcactcaacctctctggattaatttctcaattgtaaaatggaggtcatagtgcctccagtgattctaataatgaagctaaaatgaaattatcttggctctcctacttcctagaagggagtctttggaaagctactctagatttctctttctcttctgtataaaaaggatgataatgactcctgcctcacaggatcattgtgaggattacataagttaatagacaaaaaatacttagaaaaccctttcgtgtatgctgaattaatgttagtggacattattattgttagtagttagtagtaaagaacttgacacagaataattattaataaatggtaaccatttattaccactcataatacaattatcactactattagtaagatgatggaatggaaacaatgattattataatggtgacttattactagttctgacttttattgatatgacctcaaatgattaggagagccttgctttgtgataatatctttttttttatgcaaacatggttaaaagtataatgtgtgtgtgtacgtgtgtgtgtgtgtgagtgtgtgtttagataatccttctccatacatacaacaaatctcactctactagcttatggttcttcaagctttgaggcataagtaagtcaccacttaaagtttctcttctttaggcagaacagtttcaactgtccaaaaaccctttaccaatatcttgcatctttaatcctcacataatctggccaacctagccgtcactcactattgagtgaaaaaagcaatttctaaacagctttactgggatttggggagtgtgtgtgtgtgtgtgtgtgtgtgtgtgtgtgtaggcagacaggaaaaaacagagagagaaagagagaagtagaaattttaagagcattcaggaaaatgttaattctaggtatttctgggtgatgcgatttttattttctactacattaaatgtccttatttttgaactgcctgaacagcatgcataaaatacttatttttcagtagactgaaagattaattaatgtttttcaaaatgccattaactgtacttatatgataatttaagattgaatttaaaatgtggggctagaactaggaaaatggcaaagtgggacaaatatatgctaggaccatgaaaaagaaaccttatggaataaagtttgatgactttccacactccttaagagggtacctgtgagcttaaagtgatgctggccagaataacaggtctctaccccattgtgcccatggcttcctccctgtgcccaggttgtttgtcagtgactcagacaagcaatgtgcaagtatctacagcatacctaaaggtcatctggaagacttggccttggttcacatgctgggtccggttgttgtaaccatgtagcatctctccaaagagggtatcattgaatttggagtcaggtttgaggcacttggggccctcgcagacatctgagagcattaagcaggattttccatcaggagccagtttgtactcctccacgcaactgtatgataaaacagagctcagaattagcttcacatcctgaatgcccccattgggggtgacctaaaaccaaggcctcctttccctgcaaaacaggtcagagtttaggaaggagacagctattctacctggaatctatctagggcacagatgtctagagagaagcacattaatactgcaaattggtaaattcaaggaaagtcatttgtgacattttggaggagtcaaggggacaccagcgtgcacgttcacacacaaagcaaatttaaagactgtttcccatgaacatacagactttaaaaagcatgacataccaattcacagggaatcatcaactagtgtctcaaaccagaatctattcccagtacatctgtcaaccaaggttgaagactgtagcaaatacaaggtttttatcatcctggtagctcagaggtgaaaccttccaggaccatggacagcacaaggcttctgttcacttagggattttagcagcctccgttggtctaacagccagaaaagcccttgacaagcctttgagacaggggtggcctcatctatggacaaaacaggcatctgaataaggtgtggaaacaatatttgcaatttgaaaagatttgcagtgacaaatctcagagaggcatgggctggaggggatggggatggttggggcaagaaatcagagatctcagcccctgaaaaatcattccagaaactggaattctatgagtgtctaccttttcaaagttcagcgctaagcactaggagtatggtgcacataaataagacagacaagagaatggtctgtgagattggacagacctgtacaaatgccatttttctccttgtgacctatatgaacatgagtgagtcatttaacttctatgatccccagtttcctcatgtgtaaaatagagtagacacttctaccttaattcagtaggatgctataaggtcacatgatacattggccacaaaaaaaacaggaattgcaatatacttaacacaataatcataatagtggtagtaatggtgttatttctatttattgagcatgtactattcactgaacactttatgtatttattatctaaccatgaagaaagaaagagtaatatcataatttctgctttacacataagcaaaataaggagccaagaaataaagcatatagtactgtgagtaagtagcaaagttgatattcaaattcagttctgttagaaaaagggatgtttgtctatttttgtctcctccaaatctagtgctttctatgtgcacaaaatgaccctggttggtatgtcagtttgagaaagtaaacagcaggcaatctcttatttgccttttttcaaagggtgtagcaaagattcattgaagctaaccgcaaagggactcaggaactcagatgggagaaggaagaggctctgtatggtggtttggaaagaaaatgtacacaggttgtgggaaccagtagctgatgctacagatatagagctgaactggaggcagaaagaagacaagcatagctggaaacctgacccaagatcactctagtgaaaagccaggaagtctcatgcatgaagcaaactgtcactgtttccttgctttcccctaatccctggcgtactgcactgatgcactgatggtctttctaacgttcaaatgttcctttccatagtacagtggggaaatctcttggaaaagggccctgtctcagagccttggtaaagtatatccccttctttttgcatctgttaaatattactaagtcccttttaatacagttgcagtgcagatgaaatgagtgtatatggaagtgaatcgtacatggtgagtgtttcataaagtctagttccatccatttattgagaaaatatggagaaatggtttactgggtacactggctagagttctctctctctctttatttctctcaccctccacacatacccacatccctgtgtgactgtgaataaatatattattgttgaagatgagtaaacattatcaaagtctggcagggcgcagtggctcacgcctgtaatcccaacactttaggaggatgaggtgggtggatcatgaggtcaggcgttcaagaccagcccagccaacatagtgaaatcctgtctctactaaaaaaaaaaaaaaaaattagccaggtgtggtggcagccacctgtaatcccagctactcaggaggcggaggcaggagaatcacttgaacctgggaagtgggggttgtagttagccgagatcatgccactgcactccagcccaggcaacagtgtgagacttcgtctcaaaaacaaaacaaaacaaaacaagacaaaaaaaccattatcaaagtctatagagtaaaatatggaacttcttcatttcccactcctcactttctgtcccagaggtcaccattgttaatttttatgtgctcttccaggagtttttcaatgcatttaaatacatattgtgtgtgtgtgtgtgtgtgtgtgtgtgtgtttgtgtttgtgtatacagaaacatttctttgaatctgtcgactaaattggggggatttatataaacacacatatgcacacacacatctcataataaactcataagcagaattacactatatattgttgtgagacatgcatttgcacctgatgcaatttcttggagatcttttcaaaacactatatatatagatctatctttcttaatggttatttggcattgcacagtataaatgtaccataatgcttttaactaatttttattgatgggcactttagctgtttatagctatttgttattacaaacaatgccataatgaagatctttgcacatatatcattgtgcccaactatgtgtttctataaaacagatactcagaaaagaaattgcttggttaatgttttatgaattttaaaattttgatagatctactaaatagttgcctgtagaatctctacccgtttacaatcctataattgatgaatgggagatcctatttttctacatctttcatgttcattactgccaatctaggataggaaaaataactcatttttgtttggatttgcatttcccttgttactgattaggttcagcatcttttcatgttacggtcacttgcatttctccttctatagattatccattaatatgcattgaccatttttctattgtgatatttgcctttttctttgtgttggtttatatatgctcaatattttctgggtagttatccttcaccttccatatatattaaaatttttttccagtctgtgcttgtattttaatcttgcttttgatatcttattacctctttcttctggtctttgtgtctgaaatttgtgcaatgtttagaaacccacaagacgataaaatatatttctgtatattattgtagtattgtatatgtttaaaaaaatctttggttatttaatatgcatggcatttagttttgaatgtagtgtgagtgtttattttaacttaactattttttaaaatgggtagccaattgtctgaagtgtctgacctttcaacaacaaatttgaaatgttattttttttttacacgtgcaatccctacatatgccatatatacatggttggtgtttttcctgtttaattatctgtatattcctgcagtaattccaagctgttttaattactatagctttatagcctgttttggatatagtaataaagtaatactcctccccttcatcaacactagttttctatttccaaatttcctgactgctcttccatatttttcctttcaaatgaatttcagaatgggcttatcaaattatatgcaaatccctagtggaattttgggtggcattgctttgaatttgtaaactaaattgggggaagattttaatattaattttatttcattttcttttatttaatatatacgttttgcgagttaactctgtgctgggcgcttctgataagtgtgacaaagacatcttgcattaaccacactgtgtcctcttcctggacttgcattgcattgggtcctcttcctggacttacatgtctaagcctgtcttgcagttgggctgaaggggccatgtaactggattctgaataatggaatctatgctgacatgattcaagtcactgccagaattagtcttttcaaaacatcctgtgatttttcaagctgcctcttcccttgttatggcaagcttggagaccatgcgttcccgatgcattctacaggatggaggaagactgccacaattacaatagaccgtgcacaaataagaaactagcttttgtgcacaagcttctggttgggggagggggctcatttgctacaggaagaaagcttatcttatcctaatacagcatctttataatttggagttctctaactgagaaacagtttgtatctctatttatcaactgttcttttaaaacatttggtgaagtttttgactttttgttataaaggttttgcacgtgtcttttggaggttattcatgggcatttatgaaaggcactatgctgtagaggtttatcgaagtatgttttggatccagactaacagagtccaaatgctgagtctgccacttaccagttgtgtgacctcggacaaactacttaacctctctgtaccgcctttgcttatctataaagaagatcatgtgtgccttttagagtgaaaattctactgttgcaatcttttaaacttcagaaataggatcagtttttcatttatgctttcttttatgttttctacatagttattactgacttgagaaaagctgttactgatttttcgaagttgatgttgcatcctacgaacataaagaacttaaacattctaacatgtctactaaatttttctaaatggagagcatatatttgctcagtttgggtattaggattatggaataagttaaaaaactatccttttttgtttctttctctggatcagtttatataagatagatgttatccattacttgataatttgataagtcttgcctataaaatcccctgggctcgatggcttcttttcagttgtagatatttagctcttatcatttatttccttattatctgcctatttagattttctatatcctcatgactcaaacttcgtaatttatattttctaacattataatgtattttatcaagactttcacatgtattggtgtaaagttctatgcagtgttctcattaaatttcttttatcttttatgtttctatagttaaggcactagctcattcgtaatgtgttcgtgttctttctttgctctctcctttgaataggctttttgtattttgtattttattggtgagctcccttttttcttttctatttaatttatttcagcttttatttaattccttcctgctgttttatctgactttgttttataattctttttatggctgcttaagtcaaatgcctcatttgtttattttcaatctttcttgcttcttaataaatgtcttgaagcttctgactgtggctttgcccacaccccataagtctgacgtgcagccctcatgctcctgctcatttctaatgaggtgaaaatttgagtttgattttttccatatccaagtgtcacttagaagatatttaaaaatataattccaaaatagataatttgtttgttcctctttttctaatattactgcatttttagactaacagtgtagtttgtataatttctatgttggtaaatttttgagattctaaggtagtcacaagttgagattttagagctaactaaacttgagttcaaatacaggttgtgccatctaccagttacatgaccttgatcaagtctgctaatttccgcaggctttggtgtcataatctattaaggaaaatgacaatccttatcatggggatgtgaaaattagagataacttatacaaaagatgaaactgtatctctcatatagtattcaagtaatgcatcagctattatgcttattattgttattgttgttgttacttagtccattaacccatttacatatcccaggaagtataaatttatttctattggttctcatatcctagttgctggcctctatctagatccagatttctgaaagttgacatagttgccattctttgattccttttttgtttttctgctgcttcacagtgtatgtttgagaacttcttatgttgcattcattggaaataaggtatacatataatttgtatatatttttacatgtggaattatcatatagaagttaaatatatgcattatttgtgtgtgtgtctctgagtgtgtgtgtgtacatacacacgtatttgcaaagctcagtcccacattcaggatcccaaagtttagtggaatgcttttgtatatatgacctggtttgctccttataacctgtaataggtagaataatggcctcctcaaaatgcccacatcctaatcccgaacacctgaggttatctgacatggcaaaggagactttgaagatgggattaagtaaagaattttgagctggaaagattatcctggattacttgggtgatctcaatgtcatcacatgtttcccataagagggagataagcgtgttagtcagaggaggaaatgcaacttagaagcagaggagaataagaggggagcagagtaacggaccatgagtcaatgaatgcagatgctccctagcagttggaaaaggcaaggaaatagatcttcccctaaggcctccagaaggaatgcagccctgccactgtcttgattttaagaatattgaccttgagaactgtaaaataaagtgtgttattttaggacactaagtttgtggtgattcattacagaagcaataggaaatgtgagacactcacagggaggtattgtctccactttcagatgagaaaattgaggtttacagaagttgagtgacttgcccatggaggtatgtctagtcaatagtggtgctgggaatcaaaacttaggagctcaagacgtgtgtgtgaatgtgagtgtgtgtgtacgactttaagcatatcacaactgtggatttacagtgatttttcttttccctgtgggtgggaaaagattgtggcttgcaggagagattcagggggaaaaaaattcccatccttgtaaaggaaaatgatcccctgagttttgaaacaggagcagttctcccccgccgagccacctaagggcataggaaggtttatgctaaggtctatttagttgttgggttttttttaaattttatttttgtactatgacacataattatatagcttctttagaacattctgtcatctgggagattttcctacagaaattctaaagagtgtaggctcacaggaaaccagccaagatctacatgaaactctatttatacatgtgccaaaatgaaaaatataaaataagtgcagagatacataccgggcattttagctgaaggcaatggatgtgttacccttaacacacccatcacattatagagaataccaaaactagatgggattttagagagtgcaccataaaaccttctatgtgtttagctcagagcatgttttatttaatcctcatagcaacattgtgagatgggtactttcattccaacattgtcacagaggatcctgaggcttgggacatctaagctcactaatcaaggtcacatgagcattttggaaaagccagaaccttgacttgggtcttcttactccaaatcctgtgctccttccagttaattacaaatgacctcttcctatctgtttgttgtttgaaggagaaaattgagactgacagacaaatggtattgtgtacaaactctcaaagcaaagtatttctttttctcatgtattttttccttatttattaatttattcttcaatggtttgtggaatcaacagaattatcaaaatacatatcctagaaactttttgaaaataaggaaggaatcaaatccttaaaaatattaagaataggccaagtgcgatggctcatgcctataatcccagcactttggggggctgagactggcggatcacctgaggtcaggagttcaagaccagcctggtcaacatggcgaaaccccatctctactaaaaatacaataaattagctgggtgtggtggtgagcgcctgtaatcccagctacctgcaaggctgaggcaggagaattgtttgaacccgggaggaggtggttgcggtgaactgagattgtgccattgcgctccagcctgggtgacagagcaagactctgtctcaagaaaaaaaaaaaaaaaagagagagagagaaaagtagttaagggtaagaatagctcaaggagctgcacaacaggtagacttggaccaacgttaggaataaatctaagtatcctattactaaggcaagaaaggaacaggttccttcccagctttcctagtgcagaaacctgtgaaaaccccaccctgggatcatcagggctagaaccagcacctaaggaactcaactgcattaacccttctaactgatatcatgggaatctttttcaccaacaccctcaggattgtcccaacattaaccaaacgaagatcagaggaggtgttctctgagcggtcttgggttgcaggttttattcaagggaaaatttagagtttctagaaaaagaaaagaaagaagtgaatagaaaatggaattccatgggaaactctggattaattatatagcagattttatctagtctaagacccctaataatggtaagaaacactctcagtttacataacactaagaaagaaacaaggaaaaaaaaaagactgccaaataaactctgtcaaatcattaaaactaagataccttcccacttcagaaatgttaaaatgtggaaaatatgggcactttagaatcaatgaaatatgtttctccactgcatgatttgggagagccttgactatccccaggcacactgggaacctgtaagaggcagttaggagtgcagatttttccacatgggaaactctgaacatttagtttgttgttgttgtttaatatttgaatgtctcatggaactaatgttccatacaatccacactggaaaatagctatccaaacaaatggatggatattacgtgtttccatcaattgtcggtgagcattttttacacctgagcttttacaaatgtttaaaaagaagagaaaacaaggttataatgtttgacaagaacctggcatgaaagtattctatgttaacgattagaagtaaaattcacgttctccaaccagaaatgaaaggggtaagggctcaggctttaacctaaaaggtggaaaccacaataaaacaagtgcctgaatgaattcccccatctcccaccaactcttccacttgttactgataatcaaaatgaaggccattgtctctgttctgtcgttcagtgttttctactgttagactagacttcagctttgacaatgaaaatacgtggcttccagttactatgcatattaaacatgtttatctcctttccctcttaaaattacataaagagaatattagacagagaggctattaaggactatttgaggctggatgtgttatttgagctaatgtgtttttagggcactttcatttaaattggaagcaagaaggttgggatatctcaagcttctatcccaattttacctcctaactggccgtgagtgcccccaccttgagggcctcagtttcctcctctaaatgatctgaaaaatactgaaacttaaaaaatgttaatgaggccgggcgcggtggctcacacctgtaatcccagcactttgggaggctgaggcgggtggatcacgaggtcaggagatcgagaccatcctggcaaacacggtgaaaccccatctctactaaaaatataaaaaattagtcgggcgcggtggtgggcacctgtagtcccaactacttggcaggctgaggcaggagaatggcctgaacctgggaggcggagcttgtagtgagtggagatcgccccactgcactccagcctgggcaacagagcgagactccgtctcaaaaaaaaaaaaaaaaaaaaaaaagttgatgaaatggctcactatctcttacataggaatatatgagaaataactctcttagcaaataacggcagaaaaaggtgtataactcctgaaaacaaaacaaaacaaaaaaactacaactttccttttctcatacaaggacaactatataatccactatgggtattttttctctttctctgtttactttggttgccaagaagcacacagccaaatttatctcatgttgagtgactctttcattttgagcttctgaaaccattttctctcccctccttaaaatggctctgatgattcctatctttatatgaatagccttttaaaaatatattgtctttatgtgagtaaaataagttctcttggaagtgtgcatggtagactctgtaaacacatacacacacacaaaacagacaaactttgttgctaggtaacttgccaaggtcttcacaggaggtgatgccctctcacctataagactggttctaaggatttattctacaggctttagcttagtgtccaatgaccttctcaatctatcttgaattcacctgcttctgtctaccattctggtacttgtgctctgtcaatatcaatcaggacccagtgaggcttaggcacctctttgcccctgctggagaagaactctactcaatgattatttgcacctaataaaagaccaggcacagagtagtcacaacaaatcttaggcggatgaattctttaattcaatcattatggttctaaataagtctttgggccaagcagtgggaatggcaatgaagacatgcagatgcctaggatgtagtccctgctcatgaggagttcacagtatgacagaaacagacaggaatgcaggtaaatcaaccaagctatgaggctatcacagggagagccatggggcctgtgcagccccagagaaaggatgatttactctgttttggagaacgtaaactgatgagagggcagccagccagaggtccagtctccaagagatgtcaagatttcactgggataaataagaatttgagacaaaatgtaaatattcctttcccttgtaggtagaaatgaaaataaataaataaataaataaatagacgagggaaaatgtcatttctatataggccctaaccccatgcaacattcagccaatatttaaatagtatccatttgaaaggatgaatattggccaggcacggtagctcacgcctgtaatcccagcactttgggaggatgaggtgggcagatcatgaggtcaggagatcgagaccattctagctaacacgctgaaaccccatctctactaaaaatacaaaaaattagctgggtgtggtggcacgcacctatagtcccgggtactagggaggctgaggcaggataatcgcttgaacccaggaggcggaggttgcagtgagctgagatctcaccgctacactccagcctgggtgacagagcgagactccatctcaaaaaaaaaaaaagaagaaagaaagaatgggtattaattatcttgttccaaggtaactgcataactcacacctgatgcctcttagggctcagagaaggcttgctgaaaaagtgatgcctgaattgaaacttggaggcgaaagctaaagggccagggacaaatgggagtcagtgggggtacaaaggagaaagagacaggagacagagggaacagtgttgtgaaaactccagaaactgaaaccaggaggcttaacttaggaagaggaacctagctggaaatgaaactggaaaagtcagactggaaacttctttagccatgttaatggaggaactttgcttaacaactattaattgaaaacctactatgtgccagtcactgttttagctcctggagacaaagtagtaaacaagagataaaatccagtaattacataattaaatgagatggttttatacttattagactaattataattatggtttactgagtgcttaactatgacagctcctgtgcatgtataatttcatttaatcttcacaatggtgctacaatcacttctaattctacatgaaagagcataggctcagagaaattgagtggcttgccaaagatcacatgactagatgtggccagaggtcagcaatgacatcagatctgtcttgactgagcctggaaccacaatacctaagtttcaatctcaacaacctcacttaccagatatgtgaccttggacagttactgagccactctgtgctttttttaaaaaaaaaaaacataaaatgggaatcataatagtaacatcgcttgtagaattgttatgagaattgaatgagctaatgtacccaaagcacttagaacagtcatggtacgtagaaagtcattagtaaatgttagctgctattattaacctggttgcaaacagatttattaaaccttctcctacccagaacactcttaggaaggtcatagagctttgagcaagttgggaaggtccccttgataatgagtttattttgttttccctgcttaattcaatagcatcccacttctctctggaccatctctctcacaagtatctgctaatagctttcattgtttacagtgcttctaacaagtgtggtaacttctcatttgcattcctaatagacagtttccaaatcctgttgaaactgcagttggttttaggatgcctgggttttgttttttgttttttttgtttttgtcctatttattaccatttggatgggttttaacagctcaccacacactctcacccattcaatcttctttaagacgctcacagtcctttcacaatatattaacagattagtcctgtctagtgcatcaggtcactagcaaatgttattagaatcacttaagttaatttatttaacaaacacatacagtgctaattctgtgcaggacattgttccaaagcatttcacaaatattaatgtaaatggtaatatatttagtccttataacatctctatagacagatattactattatccctgttttacagatgagaaaactgaggcacagagacataaattaacttgctgaaggttacacagcaaggagatgttgagccacatcactagtcatatgaccttgggcatgtttcttagccttcagagggtaacaaatatgaaatactttcctctcttcagaattatcattatattaaggtaggtattaaaattttactggtgagaaaatggaaggtcaggggtcctgaaaggcttgccttatggctaagggagagtggcagagctaggattacaattcgtgtcttttgaatccacggttccctgtaatgtgctgtggatggaaggtggtaatagtttctgatgtcaaaatccattattgctgctcctgctgctgttactgttattatttaccacagaagaacagcccccaccccaccccaaacacacagagagaaaaataacaatgacaagaacatggctgattctggatgcagcctgcagatctaaagccatgcataatttactcaacactgccctgcagtcacttaagctgaggagagatcgctataaattcaggtctgcataccctaatttatttcttatttattttgctgatacatatctagggcctccagtgagctgcttctacacctgcacaaaggcacctgcagccctaagtgcaactagggcaggaaaggagaccttgaaataagccctggaagaaaaactggactctacacactagaatcatacaagtttaattcatttttctggtaaactggaattaaacccatgcccacactcaccccctatttgtgaaacacaggactgaaaatgttgttacatgtcctgttctgcttttctatcttagtaaagacagcattaaatgtacttcttccatgagtacaagattatttttctgagtcacagaatgtcaaaagataagcaaatattctaatactaagacataatcagaaagggaatgaagagaagaaaaaagtctgttcttgtaagtgattactaaggaccaaatgctatatgcaaggtgctgtcaaaggcagaagtaatggccattgcagtctttaaatggaaagcaatgtaagttggaagaaatgtcagccatccttccccaaagatctcttttcacagatggtcaaactgtggcccagggagagaacatgacttgtcagaagtcactcagcaagttggtcccaacgtgttccccttttagcctcatacttatttcaaaagtcagtttgagtccttcaagagccagagctgtcctacaagcttcacctgtgttgtttcctttagccctcccctcctccagttaattgtccttacagatacggacattaggacacagaaaggctgaacagtgccctcacattgctacattcctgctgaaaccaagcttgaaggctggacttagcctgtgcttttatgcaccatacctgaagcctttgtgaaccttcaagacgtctgcttttgtctccaaactgcactgactaggcccatacaggtagattcagaagggcaggaggcttcagcaggaaaaagctcctggctctaggatgaggcctgggcatgggttatatttattacatttattaacccaatctttatttttctcatttttttcttttttaacccacccaacagaaggttatacttttggcttttggctcttggactaaaacaggaaaggcagaaaggccattttattgaaggtcaaggttcagccttgctgagctgtagtgtctgatcattttcccatgcatccctcacttctgtaaatggggcacctgggccttggggacagagactcacccgcagaacatgaagatggtgctcgaagtggcatcgtagggcaggggcagcgtctgctgcaggcacagctgctcacagccgccattaaagccatcagagcagtcaatgcctttggagtggtcgtagcagccagagccatccttcatgggtttcagctcctcagggcactgctcagagagagggcaacagggtagttatggcttgggaggttgtaggccccatcacaccctctcctccctcctggaagagacatgtgtcagggcctgacagaaaggtattcagtctccttttgtcagttaataactttgtgacaagttccacaagtccctttacttctctgaacctcagtgtgcccacctgtaaaatgggacttttgtgactatctgcttatagtgttgtgagaatgaagggtgataatgtcagcaaagtgttgagaacactggctcacacggcaacagcacagcaaatgtcagctgctgctaatattgatattgctgggatcatattcattattgtttctactgttattgccctatagggtctactgctagaagggtcacatagggaggctgccagatatatatttaaaagcctctaccagtatgagtgtaatttccagcttttcctcttctcactgtgtgacccgagaagttacttgccgtctctgagcctcaatgttctcatctaataaatgggcacaatacctgcaactacagatttgttgtgaagcttaagttggatcatgggggtgcataccttacttcggaatttggcacataatttggtactcataaaatgtgaattaccttccttcctgtcttgaattagtctcttcttctccaccattatccctggagccctaagtaagattcctgcatactcacatcaccatgaaaagggctcctagccagtctgctggactccagtcaggccttctcaaaaccatcctccaaatggccaacagagtgctatttctaaatagcatcactccccagcttaaataagtaaatgaatcttaaaacatgtgaagctgctataaactgataatcaaggtcctccctttatagacaacctagtcctctgcttggccatatgcacagccctccccatagccctctggtccctaagtaaactccaaggagttcaaccttcaatggcctcagctagaacgctcttgtcagtgggtctggcacctgctatgtgctccttcagtggaaaatcatatactgtggagacagatggctattgattaaatttagttttccatcatttgatgaggctgagctcatcttctccatcccagctgatggagaagtagttccaatactcctgctttcagaagagaaaatgaggtactgggtttttatttcagtcctcccgctggcatttcttgtccacaaagattaacacccagagcccagccttcctcatccatcaccggacatcactgattaaaatgccttcccaccatgagaccccaccggccaactccccgctccccttcccatgccatcgtcctaaacaacatcaataataaaacatactcacaaaaattaatttacaaaaaccacaataacaaaaaaaaaaaggtcagccctcttggaaattaaattttgcctgagaagaatttgtaattacaaatgcatgagagagttcttcaagacatttgagactggcgccaggaagagtgacggagaaagtaggttataaatggcctttgtcaagctgcagaaaggttataaaactgctgcattttgtgcttaaaaaatcaattttccatgtgagtgaagtgctgtacatattaatacaagctcagaggaagcccctgcttgtctctgaacattcactgtcagacaagagggcacctggtcacagggtcatttggagccgtttgtgagtactggggcctggcttcagtctgtttgcagactcgcggagcatgttgaaaagaatgactgattttctgaccaggtaacaggagacacctgggcagggtatggtctcagtccttcccatcccccaatgattctctaccacacttgtttttttaaacgtgttcactaagctccaggttttatctaagcgctttacccgttttaacttatttaatccctatagcaaatatatgaggtagagtggtaggctgataatggatcccaaagacatgtctctgtcctaagccctggaacttggaatctgtgaatgtgactttctatggtaaaggttatgcagatgtgattgtgtcaaaactcttgaggacaccctcctgggttttccagattggcgtaaatgccatcacaaatgttctcatgacagagaggcagaaagaaattacacacacagaggagaaggcgatgtgggggtggaacagagattggtgtgatgtggccacaaaccgatcgatgctgaggccaccacaacctgaaagaggtcaggcacagattctcctctagagcctccagaaggagcaccaccagaaatcaaatgccagcaccttgattttggatttctggcctccagcactaggagagaataaatttcttaataattatcttaagccactgagtgtgcagcaatttcttgcagcagacaaggtaggtaccgtcaggattcccactttgcagaggaggaagcggaggagagggtcacacagtttggtggtgacagaggcagagcttctcaggcttcccaactttgttgctattagctgcctaatgggcaagccacttcaccaccctgtcatttactgactgactgatctctagttttaagaagtcctgtcatttactgactgactgacatctagttgtaggaagtcctgttatttactggctgactgacatctagttttaggaagttagaataaggcagggcttagagctgatctaacctccttactttagaagtgacgcccagaaagttaaaggacatcaccccatattcctcagcacatgagcgaagaacgtgaagccaggcttcccttgccccagcttggtgttctctgtccactacactcacttcccttcaggttaaagcattttgcaaacttacatatcctatagtctctctccccaagatgatttgctgatgggaaactgaggatcagaaaggtgagggtacttgaccaacatcacacagcaaattaaaggcaagatttgatccacgcctgtgggaaaggcttcctaagtacatgaagtgggtttaccagttaccatcattccttcctctatcatggacttcaggtactgtgcctttgaggatgagtaggggcagatgagatctagccatcgtttgaaattacttgtatattattagtatttcaattagtttgttgcttactgtctgtctcctccaccaaaatgtaaatgttataatagtatggaccatgtggcttgtcctaagccatctggcacacagttggtacttgttatttgctgaacgaattggtggagtgctagaaatgacatttagtgtatctgtgtattaactttggatctgaatccacactacttcttataagttgtataaccttcaggcagtgacataaagtctcctatcttcacgtgattactgtgatgggtaaatagtacggtagccagcttcaaagatggtccccagtgattcctgccttctggtattaagactcatgtagtcccctcctacactgcaccagaattggtctatgtgaccaatagtatgtggcagaagaggaggtatgtggcttctaaaggtagatcataagagagatctttctctccctctgtctgtctctctctctctcatcacttgctctagtgaaagcaagctgccatgttttcagcagccctatggagagtcttatgtggcaaggaagtaacacctctggccaacagccagtaaggctggggcctgccagcaaaacatgagtgagcctgcaaatacactatccagccccaatcaagcctgttcagatattggcaaccccaggtgacattttgactgagactttgtagaggtaggccagaaccacacatagaagctgcttttgaatttctgacccttaaaaattgtgtgggataataaatactttttgttttaagtgacttgatttttgagataatttgttacacagcaatagctaactaatatagtgaaataaatgtatgcagtacttagcacagtgatcaacaaatagttctgctgttataggtatttgtaaagagcttagaatctggtttgagagataaatatacacatctatcagagaacgttagttatagaacaaacataaaaaagtatggtaaaatttgtttgggaaaataaaaactctgcaaactaggcaatattgaaacagggaggttttagtcttttctcctcctctaggaagggaatcctgtaggaaggaagttcctacaggaagagaaaagagacatctaatgtactagaagaggaagactagaattcattaccaggcactgtcacttgcttgcctcgtgaccttggacaagtccttgaaactatttgggactgttttctttctataaatagaggagccagtttggagacaagaatatgaggactaaagtcaggcctgaattccaaggaaagatttgtgacactgagcatataggcaggatgcttcacctcagagacagcctcaggttcctcatctgtagaatgcaaataatgtctctcttggaggcacttctgaagactgtatgagaaaacacttctaaagtatctggctttagacctggtacataatagacacctaataaatgaagaataattgaatagggatatataaacaagtaataaattaaccaaaaccccaaaagaaaaactagcctagttgggaggaatcacgatgtctgactagatgcaggtagtatgtccctcctccatggagaggaaccagaataataagtagatacacacattccaaacagattgtctagaagagaatgctaggattcaacaggggagaaatgagaagcaccagaagtaagtaagcagagactttgaggcagcttttccagtcagaaaccaactgagagctggaaggggctcccagatgtggggaaacagtaagagagaaacccccagggttccaaaatggggttttacaccttggctgtgagagaaactctcaacctactggggcctttggcctgacatacgaagtgcctaaagtttgcataaaaccattgccacagaatgagaacccaaataaaatcccacaggcatctgaacctggagtagacacagctgggcactattttgagagccaaaatactggggatctacagatatggctgctgctgccctgttctaaagagggagagggaagactgggtgctcccacacatccccaggaagctccttactgccctgctgcaggctgctattgagactgagacatggatagactgtacttcccacagcttcttgctcacctttcttgcctgagatggactctgccttctctggtatcaggcccaaagcaccgtttttgacagtttaatgctgagctgcaccctaccattggcatgagtttgggttgatgtggctgcagctgccacccagtcaaggagggacagggagaccaggctatcctatgcatatctaggacaatacccactgccctgcaaggggctgctgtgagaccaagactcaagtgggccacactcaccacagcttcttgccaatgtggctcacctgagaaggaccccatcctttctggtcacagcccacagctggcaccatgctgagcatttaatgctggactatgtcccaggcttggggccgagtttgaggtaacatggctgcagccaccaccctgctgggagagggacagagtacaccacactctcctaagcacactcaggacaatacccaccaccctgctatgggtggctgcgagactggggactagcccgcccaacccatcacagctcccagcaagaccaacacgggttgcttgagtcccagtgggttgctctaccaccatcattactgccatcagccacactacactagcttcccaggggccccaaaatctacccatacatcaggcccactgctcccactactagcttctaagcaagccaactaatggcccaagaatcagccctcaaaaacctactaacactgaagccagtgtaagctacttcggggcctaaaaccaggcacactcaccccactgctgccactatcaggtgtgaagactggctcactttgtattcaaggtcccagcttaacttcaccacaatctcaactaacaactgtgtgataatgaaaacacagtatctcaacatgtgtattatacagcaaaatcagtgctaagaggaaagtttatagcattaaatgcctacatcaaaaaattatcacaaattaacaacctaatatcacacctgaaagaactagaaatatggctgggagtggtggctcatgcttgtaatcccagcactttgggaggctgaggtgggcggatcacctaaggtcgggagttcgagaccagcctgagcaacatggagaaaacccgtctctattaaaaatacaaaattagccgggtgcggtggtgcatgcctgtaatctcagctacttgggaggctgaggcaagagaatctcttgaacccaggaggcggaggttgcaatgagccaggattgcgccactgcactccagcctgggcaacaagagcaaaactccatcccccccaaaaaaaaaaaaaaaaaaaagaactagaaatacaagaacaaaccacacccaaagtaagcaggagaaaagaaataacaaagatcagagcagaaataaatgaaatagacccaaaaagcaatgcaaaggatcaatgaaatgaaaaaataattttttgaaatgctaaacaaaattagtaagccactagcaagaaaagagagaagactcaaataaatacaaccagaaatataaaaacagacactacaactgatgccacggaaatacaaaagatcatcagagactattatgaagactattatgttcacaaaccagagaacttagaaaaaaatgaatatattcctgactacacaaaacctatggagattgaaccaggaagaaacagaactcctgaaccgaacaataatgactactgagattgaatcaataataaaaaatatctctcaataacaacagaaaaagccaaggactggatgaattcacagctgacttctaccaaacatccaaagaaaactaacaccaattttcctgaaacaatcccaaaaaaatgaggaagaggaaattctttctaactcattctatcaggccagtatcaccctgataccaaaaccatacaaggaaataacaacaacgaaaaagaaaactatacactaatatccctgatgaatatagatgttagtattttgcttaacaaaatactagcaaaaggccgggcacagtggctcacgcctgtaagcccagcactttgggaggctgaggcaggcagatcactaggtcaggagtttgagaccagcctggccagcatggtgaaaccctgtctctactaaaaatacaaaaaaattagctgggcatggtggcacacgcctataatcccagctattcgggaggctgaggcaggagaattgcttgaacccgggaggtggaggttgcagtgagccaagatcatgccactgcatgcactctagcctgggcaacagagcgagactccgtctcaaaaaaaaaaaaaaaaatactagcaagtcgaatccaacagcacatcagaaagatagtacaccatgacatcatcaggtggaatttatccctgtgatgtaatgaggattcaactatgcaaatcaataaacgtgatacatcacataaacagaattcaggaaaaaagccatacaataatctccatagatacagaaaaaaaagcattcaataaaattcaacatcctttgatgataaaaaaaatcctcaacagagtaatcattgaaaatacacacctcaacatagtaaaggccatgacccacagccattatcttactggggaaaaaaaagcatttcctctaagaactagaacaagacaaagacatcccctttcaacactcttattcaacatagcactggaagttctcaccaaagaagtcaggacacagaaaaattaaaagttatccaagctggaaaagaagaagtcaaattatccctgtttgctgatagtattgtcttatatctaaaaatccctaaagactctatcaagtttcaagataaaaaataagatgcagaaatcagtagcatttctatacaccaatctagctgagaaccaaattaagaaagcaatccatttacaatagccacaaaaataaaatatctaggaatatatttaacaaggaggtgaaagatctctataaaaataataacaaaacactgatgaaataaattgtagatgacataaatacacagagaaacatcccatgctcatgaattggataatcaatatgtttaaaaggattatattgcccaaagcaatctgcagattcaatccaatccctatccaattaccaacatcatttttcaaagcattagaaaaaaaatcctaaaattcatctgtaactagaacagaccccaaataaccaaagcaatctcaagcaaaatgaacgaagctagaaaatcacattatctgacttcaaattatagtacaaggcatagtaaccacaaaaccatggtattggtataaaaataggcaactagatcaatggaatagaatggagaacccagaaataaagccacatacctacaaccaaatgatctttgacaaagtcaacaaaagtacacactggtaaaatgatactccagttgtattagtccgttatcacactactataaagaaatacctgagactgggtaatttataaataaaagaggtttaattggcttatggtttcagaggctgtacaggaggcatggctggggaggtgtcaggaaacttataatcatgaagaggaaagaggcacgtcttcacattgctgggagcaggagaaagagagcaaaatgagaagtgttacacactttcaaacaaccagatctcatgagaactcactattgcaagaacagcaaggggaaaatctgcccccatgatacaatcacctcctaccaagcccctcctccaatactggggattacaattcaacatgaaatttgggtgggaacacaaatccaaatcatatcactggtcaataaatggtactgaaaaattggatagccatacacagaagaatgaaactggactcatatttctcgccacatattttttaaaaacctcaaaatggattaagacctgaaactataaaaatcctaaaagaaaacctagaaaacaccattttggaccttggccttgggaaagaatttgtgactaagtcctcagatccaattaaactaaagagctacacagcaaaagaaactatcaacagagtaaacagacaacctacagaatgggagaaaatattcacagattgtgcactcgacaaaggtcaaatatccagagaccataaggaacttaaataatgcaacaagcaaaaacaaataaccccattaaaaattgggcaaaagacataaacagacacttcttaaaagaagacataagagtgacccacaaacatatgaaaaaatgttcaacattactattcagcagagagatgcaaatcaaaaccacagtgagataccatctcacaccagtcagaatggctactattaaaaagtcaaaaaacaacagatgctggtgaggctgtggagaaaaaggaacacttatggaatgtaaatgagcacaacctttaaggaagacagtatgaaggtttttttttaaagaactaaaaacagaactaccattcaatccagcaatcccactattgggtataaacccaaagagaaaaaatcattaattacattaggtcggtcacggtggctcaagcctgtaatcccagcactttgggaggtctaggcaggtggatcactagaggccaggagtttgagaccagcctggccaacatggtgaaaccctgtctctactaaaagtacaaaaattagccaggcatggtggcaaatgcctatactcccagctactcaggaggttgaggtgggagaatcacttgaacccaggaggcggaggtcacagtgagccaagatcgcgccactgcactccagcctgggcaacagagtgagaccctatgtcaaaaaaaaaaaaaagaagaagaagaaaaaaagaaagataccagccctcatatgtttactgcaacaataataacatacgagtgctatttcataatagcaaaaatacggaattaacctgaatgtctatcaagagttgattgaataaagaaaatgtggtatacactcctacccctcccttctccccacccacccacagacacaccatggaatactactagggcataaaaaagaatgaaatcatgtcttttgcagcaacatggatagaactggaggcctttatcataagttaaataactcagaaacggaaagtcaaatatgacatgttctcacttgtaagtgggagctaaacaatcggtacacctgcacgtacagagtgcaatgacaaacactggagactacaaaaggtgggagaatggaagggtgggaagagtatgagggttgacaaagtactactgattgggtacaacgttcactattcaggtgatgggtataataaaagctcaaacttcactactacacaatgtatgcatgaaagagacctgcttataccccctaaatatataaaaataaaaatataaataaaggtaactgaaactattagctgattttttcttttccatatgtctaagtccttctttagaacatttaacaaatattcaccaaacacctacctactcagtgctaagcaaatgttttaggagctgaaaatgtagtagtaaacaagacagacaagacctttctctcatagaatttacattctagagaagagacaaataattaacaagtaaacaaacaaaatgattattttgtagagtaaaaaaatgaataaagataaaagtataatatgataaaaagttaacgaggatggggtgaaagcagcataaatttagcttaaaaatagggtagacagacttcttccactttagccttctttttcaaaagaagttttggccattatagttcctttgccgttcgtttaaattccagaaaaatcttgtctatacttataaaaatcatgccgaggttttgataggaattatattaaacctttatatcaattcgaggcatgtggacatctttattatcttgtgctatccaattcgtgaatacgtatatctttccttgtgattagatcttctttgatttctttcacgagtattttaaagttttactaaagctaaacgtggcccatgcatattttgtcagatttgcatctgagtatttcattactttttagggattgcaaatgatactgtattttttatatattttgtcagattcacatctgaatatttcattatttttcagaaattgcaaatgggattgtattttttatttcaaatgttcacatgttcattgctagtatataggaatacaattgatgttgtatatttttcttgtattctgagaccttgccaaacttactaattgcttctagaaatttattttgtagattccctgagattttctatgtaaaaaaatcatgtgatctgccaatgggtaagtcttatagtcttatttcttcctttcttatctgaatgccttcttccttttttgattttttttttccctgttattgcactggctaggacttcccacacgatgttgaataacagtgggcagagtgaatctgcttttcttgtctctgaccttttggagaaagtattcagtctttcaccataaatatgtcagctgtagctcttttattgatgttcttcgtcaagttgagtaagttctcttctattcttattttttttttgaaagttttaaaaatcattttcggtatggaattttgtcaaatgtttttcttgtatccattgatatgatgatgtgatttttcttcttctgcctgttattataatatactgatagattttcaaatagggaaccattcttgcatcactgtaataaaccccacttagttatgtgtatagttatcttttatgtattgttgaatcctatttgttaatattttgttaaggatttttacaactgtggtatatgcatgagggctattggtcttactttgtagttttctgtttttgaactatctttgtctgcttttagtatcaagataatgctaatgtcttaaaatgatttgggaagtattctctcttctttaattttctggaagattttttttgttttgttttatttatttatttatttattttttgggaattgacgtttattcttctttaaacatttggtatatttctccagtgaaactatccaggacagggatttggagctgaggggaggaggagtctaaagtgacaaaataaatttccttaatagttatagggctttcaaaattatctatttcatattggcgaattgtggtagtttgtgtttttaagaaattggtccatttcatctaattcatcaagtttatgtgtgtaaaattatttgtagcattcccttattatccttttgatttacacaaggtctgtggtgatatcacctgtttcagatagtggtaatttattttttctctcctctcttccttttcagtcttgcttgtgtttgtttagttttattgtcattttcaaataatcaattttttgtttcattaacttcgttgtttttctgttttctaccacattgatttccttccttcggcttcctttggatttattttgctctttttttttttttctaggttcttgaggtgggagcctagattattgatttgtaacttcctcttttctaatgtatgcatttagggctatacacatccttctcattgaatataaagacacagatatgttaaaagaaaaggatgaatcatgacttcagctgtgtcccccacacaacttgatacattgtatttttatttcatctagttcagtccattttttaatttcccttgagacttcttctttgacccattgattattcagaaatatgttgtttactttctaagtatttgaagatttttctgttatatctattatgggctgaagatttatgtccccacaaagatttgtatgttgaaatcctaacccacctgcaaagtgatgatattcgcagttgaagccttggggacgtgattaggtcacaagagttaagcccttataaatgtgattagtacctcacaagaagaggatgggagaccagagttccctccctctccaacacatgaggacacagaaagaaggcaagcaaggaaaagggaatttcaccaaaaaacgaattagccagcacctcaatcttagacttcagcctccagaactgttagaaataagtctgttgttcaaagcacccaatttatgttattttgctacagcagtccacagctgctgaaggcagctgttattgctctgttattgctttcttgtttgattctatcgtggtcagagaacacactccatacaatttgaatcttaaaatttgctgaggctttttttatggtccaggatatagtcttgtcttgatatgtgtcctgtaggcacttgaaaataatatatgttctatttttgttgggcataatgttctataaatgttaactagatcttttttgttgatggtgttattgagtccttctatattgttgctaaactcctgtctagttcttctatcggttttggaaaggggtattgaagtatccaaccatcattgtagaattgtctattttttctttcagttctgttagattttacctcacacattttgcagttctgttgtttgatgcataaacatttaggatttctatgtcttcatggtaaatgatattttataattatttggtgtccctctgtggtaattatttggaaggcctactttatctgttattaatatagctactctcacttttgtttgatttgcatgtgtctttttccatccatttactttcaatctgtctatatcattataagcaatgtgaatttcttgcagacagtatataattaggtcatgcttttaaacccactccactaatttatgccttttaattttggtatttaaactatttgcgactgggcacagtggcttatgcccgtaatcccagcacattgggaggctgaggcaggatggtcacttaaggccaggagtttgagactggcctgggcaacatagtgagatcctatcttttcaaaaaattgtaaaaattatccaagtattgtggtaagtgcctgtagtcccagctacttgggatgttgaggtgggaaggtcgcttgagcctaagaagtcgaggctgcagtgagctgtggttgtgctactatactccagacgacagagcaaaatgctgtttcacaaaaaataagaaaaaatttctaaaacagaaattatttacatttaatgtgacctgaacatttctggcattacattatattattatgtttcaactccaggtcttaattatattaatgaagaccaattctgatttttttcttgcccaaattactatctgaggggtctggggagtcatgccctacaaatcataaattctcatcagatgggtttatttaatcctatacattgtgacttactttccaatctggctctggcataacatgagacaaggaagaaaaggcaaaatactttatcccaaaacacgtttcttgacatattttgaaatggccctgcaaagctgttctttgtagggaaaattttgcatctgtaaagaatgtctattaacatagctacatctttttctttcagaccctcccaatcctaaagagattaactaaaatctgaataggaaacatttgttgtctatagtctctaagggcagccactaaaagacgtcaaaggaactttggtctccacaatctttatcttaaccagaacatccctatatccctatagtctggaaccaacaacccgctgcccccaaaagcatttgtaaaatgtataaaacaaagctgctccctgaccaccttgggtacatgttttcaggaccttctgagggctgtgtcacaggccgtggtcactcatatttggctcagaataaatcttttcaaatattttacagagtttggctcttctcattgacatgtatttatttattttagagagaggttctctctccgtcacccaggttggagtacagtggcacaatcatagctcactatagcctcaaactcctgggcttaagcaatcctctagcctcagcctcctgaatagctgggattacaggtgtgagccactgcacccagatagaccttcaaaccttctattttctctggcttctactgacactcatccagcaggggaaggtagtggccttgttactgacaagggaatgaagaagtcccagttccccatgtggccttctctgataccccaaaggcccctcttttcagctggatgaggtaggaattcacctccccactaggacttcacggatctcttcctggatgggagtggtaggtatgtctagtcactgttccccccttaatctccactaacaccacactgagtggaaggtggccccatgaatgctggtccgtggtgaatgtcctggctttctactagttcttccctgacaacaacccagcaggaagggggaaggtgcttcaatgtcatggattaggggtggaaggccatgctcttcactgatgctgaataggccaggggatgggggtgctcactatctatcattgagattaaagtcctggctccccacgccattcaaccgttgctcccatggggaggggtgtgttcattttaatttttttcattttctgtggtgtttggctggagtagagcacttattgtctagcatttttctgtcttgctaggttgtccttttcccggtattttggctagggagagcagttttgttttgttttgttttgttttgttttgttttgttttccttcacatgtacctactggcatttctgagctgcaggctcctttagctccaagaataggacacatgaggcaaagagagaatccagggaactgaccaccatgtctttccttgggtcccaaaggcttcagctggtctgcaatgctccacctttcagtcttatgcttgttttatataggacatccagggtttttggttgtatttagccagaaaaatagagaaaatgtgtctactcctccaaagcctgtttttgcacagccctagagctaagaatggcttttacattttttttttaaaagaacatgagacaaaaaaagaccacatgtgacctggaaagcctaaaatatttactatataatccttcatacaaaaaagttgaagacccgtgacttcagccatgttaaggcacctggagtttattctaagtgcaactggaaggcataggagggttgttggcagaggaataaagtgattttgtttgctactttgaagagattactgaagttagtgaatccagttatctctaagcaatttcctagagtccacaaaaggagtctggggaagcaggctctgtgcatctgggcaggggcttgagaaagggagtgagtcagcctaataaggactctagcatgtggaggcgtgcctctttgctgaggttttatagtaagtaggtgagaaagcggggagtctaacccaggtcagtgcagctccagagactcatatccctcattctgctctatttcaggggaggactcataggaagactctgagcccaagtctctgagccttgagattttgaagacctagcggggagggagaggaagatgcctggaggattcccataggttcctcccacaggctagccctgctgggctcccccgagcttcttcctccatactgtgaacctgctctttgctgcttcctagctcgacttttcatcatcaccaagccatttgtttctgtttgtaattatgcattttaatgttcattaattatggaatgcaaattgctctgagtacaaaatttgtaatgagctgttttaccaccccacccccaggtctagaaggtgggccagctgttctgagcagaaggaaaaacaaccaacttacaaaacagaacaatttgtcctagggcctgagtgaatcatatggtaaataagcctgggggacttcctgctgatgctggaggtggggccctgccccacctgggtcctgggtgacatcagtgtggcaatttcattctttgctacaaacttgggcctgaaaggcaggtggggtaaaggaacagcactagtcttagaaccagccttttactggctatgacaccttgagctagtcccttggcttgtctgagcctcagtttgtccttctggaaggtaaggattatgatgaaattatcctcaaagtaggggtggcaggcaaacactagcaggccctggataaatgcatgtgaatggctctccagattgctggattccagttctgcctggctgtgtttttttttgttttgttttgttttttgagacagagtcacgctctgtcacccaggctggagtgcagtggtgcaatctcggctcactacaagctctgcctcccaggttcacgcgattctcctgcccaagcctcctgagtagctgggattacaggcatgcaccaacacgcctggctaattctgtatttttagtagaggcgggggtttctccatgttggtcaggctggtctcgaattcctgacctcaggtgatccgcccgcctcagcactcccaaagtactgggattacagctgtgaggcaccgcacccagccaaaaatttccagttgctttcttttctttttgagatagagtttcactcttgttgcccagactggagtgcaatggcacgatctcgactcactgcaacctctgcctcctgggttcaagcaattctcctgtctcagcctcccaagtagctggaattacaggcgtgtgctaccatgcccagcaattttttttttttttttttcagtagagatggagtttcaccaggccaggctgatctcgaactcctgacctcaggtgatccacccgcctcagcctcccaaagtgataggattatgattacaggcgtgagccactgcgccctgcctgggctgtggtctttaactggctgagagccttcagatgagaacactctgagcctcagtctccttcaatggaggcactggacagcaggaagtcagagaagactttcagtgctaactgctcagtttttatcaaagcaactgtgaattgtagaaaggggaaaattagctctgaagtatttaagaggaaaatggggaattttcttggaattgattgaacatgttttaagacatcacaaggatgcctccaaacctgcttgactatgaacaatgacttgttctcctccaaggactaggtaagtatttgatttctttaagtctcatggccagagaaagcataataacagtatcacctcctactaatagtactcctctcaacaatagtatgcctcaaaaattatggtaaatattttttatttattgttattattttttacagacaaggtcttactctgtcacccaggctggagtgcaggcagtggtgcaatcatagctcactgcagtcttgaaatcctgggctcaagggatcctcttgcctcagcctctcgaatagctgggactacaggcatgtgccatcatgctcggctaattttatttttatttttattttttttaaaacaacagctttattgaagtataatctacatatcataaaatttactcatttaagtatatgattcagttattttaaatttgcagaattgtgcaaccagcaccgtgatccaatatttaagtttccatcatccccaaagatcgttcatgtactccttttgagacagagtctcgctctgtcacccaggatggagtgcagtggcacgatcttggctcactgcaacctctgcctcccaggtttaagcgattcttatgcgttggcctcccgagttgctggaattacagttgctggaattacagccccgtgtgtgccacaccggtctaatttttgtatatatatatttttttcctgagagggagtctcgctctgtcgcccaagctggactgcagtggcgtgatctcggcatactgcaacctccacctcctgggatcaagcaattctccttcctcagcctcctgagtagccgggaccacaggtgcccgccaccacacccagctgatttttttattttattttatttcattattattattattattattatttttttttttttaattgatcattcttgggtgtttctcgcagagggggatttggcagggtcacaggacaatagtggagggaaggtcagcagataaacaagtgaacaaaggtctctggttttcctaggcagaggaccctgcagccttccacagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaacaatttttcttagtacagaacaaaatgaaaagtctcccatgtctacctctttctacacagacacggcaaccatccgatttctcaatcttttcctcacctttcccccctttctattccacaaagccgcgattgtcatcctggcctgttctcaatgagctgttgggtacacctcccagacggggtggtggccaggcagaggggctcctcacttcccagtaggcgcggccgggcagaggcgcccctcacctcccggacggggcggctggccggacggggggctgaccccccccacctccctcctggacggggcggctggccgggtggggggctgacccccccacctccctcccggacgaggtggctgccgggcggagacgctcctcacttctcagacggggcggctgccgggcggaggggctcctcacttctcagacggggcggttgccaggcagagggtctcctcacttctcagacggggcgtccgggcagagacgctcctcacatcccggacggggcggcagggcagaggtgctccccacatctcagacgatgggcggcagggcagagacgctcctcacttcccagatgtgatggtggccgggaagaggcgctcctcacttcctagatgggatggcggccgggtagagacgctcctcactttccagactgggcagccaggcagaggggctcctcacatcccagacgataggcggccaggcggagaagctcctcacttcccagacggggtggcggccgggcagaggctgcaatctcggcactttgggaggccaaggcaggctgctgggaggtggaggttgcacgagccaagatcacgccactgcactccagcctgggcaccattgagcactgaatgaacgagactccgtctgcaatcccggcacctcgggaggccgaggctgtcggatcactcgcggttaggagctggagaccagcccggccaacacagcgaatcccagtctccaccaagaaaatacgaaaaccagtcaggcgtggcggcgtgcacctgcaatcgcaggcactcggcaagctgaggcaggagaatcaggcagggaggttgcagtgagccgagatggcagcagtaccgtccagcttcggctcggcatgagagggagaccgtggaaagagagggagagggagagggagaggagactgactctaattttatttttattttttgtagatatggagtcttatgctgaccaggctggtcttgaactcctgacctccagtgatcctccatctcagcctcccaaagccctggaattacaggtatgagccaccatgcccagcagtagtaaagatgaaatgagaggtgaaaataacgagactaaacacataatgaaagccagaatacactgtcagtcacaaagaatagacacaactgtgaatgaagtctgactgagccacttcctcaatgtgtgccctggctgttctgagtctcagtttccacaatttatacattggagaaaataactccttcctcactaggcttgtgagaggatcccaggaggtcatttacctgatatgtgcctgatgcctgacaggtgctcactaaatgctaactgctattgtagttaccttgttactttctccaaataggacacattcagggagaaatgtaagggaaccatatacagggaaatggttaggcatttcttccatgcctacttttccaatgaggaaactaaaactcagaggtcaggtgagctgccttgggtcatacagcaagcaagagtctgactgagcccaccactgaaggccccctgactatggggccaaatgaggttctcttttccctgaaccacatggaggtggcttgtctgtggtgttacaagtggttcagactggctagtgtaacacagagattctgagaaccttgtgggaagggccctgtaatgagttatcggaggactttggtgctttagggacagagaggttgcttgtggcatagtcttggatgtacagattaggtacagcatcttgggaagaagagatagggaaagatgcaaggaaggaaatgaaatgcatatttattatgcacctaccataagctggatgtttcccaatatgctatcttttttaatccccacaaaactcagaggacctctaagatacaatatactcattttacaggcaaggttattgaagatcacacaggctgaagaagggctgctgaattcttcaatatgaaccatccctttgataagaaactgagtgggcctggttcttctcatcccaggagagctctggtgtgcttcctggcatataagtgagtgggaaaggctctgccagtccccagtcccccacccctcttgccactcagcctcaatctgtcaaccaggccagctagcccgtctattaatgctgacattgatttggatcaatcaagatcccataattactgggagttttaatcaactcatgccaattcagctgccgctcaatttgtgctggacttcggtgctcacaaggagggaagcggcgagggtggggtggggcggggggagggcatgcaaaaaggattacagggatcaatagtccttggtaatgaaggacagcagctgcaggcaccaccagggggcctgagacttcagagtggaggagacagagcctgcccccatcccccaggagagctccctggcagagaatgaaaaccacgcccctgcttcacctctgcctacacctggatctggaaaccacttaggcactaccaggcagcacctgttctctgcagggtccaaccctcagtatctctctccacattttgccctcagccaggcctggcctcctcttcctgaagaatcttatgtatccttcagagccagcaatcccattactgggtatacatccaaaagaaaataaatcgttctaccaaaaagacacacgcaaccgtgtgttcattgttgccctattcacaatagcaaagacatggactcaacctgtgcccatcaactggtggattggatttaaaaaaatgtggtgtgtatacacttgaaatactatgcagccataaaaaaatcatgtcctttgcagcaatatggatgcagctggaggccattatcctaagctaattaacacaggaagagaaaactaaataccgcatgttctcacttataagtgggagctaggacgggcgtggtggctcatgcctgtaatcccagtgctttgggaggccaaggtggatagatcacctcaggtcaggagtttgagatcagcctggccaacatggtgaaaccccatctctactaaaaatacaacaaattagccaggggtggtggcgggcacctgtaatctcaggtactcgggagggtgatgggggagaattgcttgaactcgggaggcagatgttgcagtgagccaagatcgtaccattgcattccagcctgggcaacatgagcaaaactctgtctcaaaaaaaaaaaaaaaaagtgggagctatatattgggtacttatggacattaaaatggcaataatagacactggggactaccagatgggggaaggaggcagggaggtgaaagggaagaaacaggtgcaaggattaaaaaactacttattgggcactacgcttagtacctgagtgatgggatcaattgtactgcaaacctcagaatcacacaatatatccaggtaacaaacctgcacatgtaccctctgaagctaaaataaatgttgaaattattttttaatcaaattttaaaaaactctgtaaattatttctcagcagtctctgtggttatgttcctgagttcaaaaagcagaagaatgctgaggagacaaaaaaataaaaataagattaatccagatactgtcatttcctagctgtgtgacttcaggcaagtcactgcacttttctggtcctgtttttcctgttctaaaatagactcaataataaataaccgcctcctgggattgctgggaacattgagtgctgtcacgaatgaaaaatccttgtgtggaagttccttcttccttttgatgtcccacatcagaaagaatcagttttctttttctcccatgttcattattcttctcctagcacaagctttattctgccaggtgggacggtttctgggtcacagtctgtttccctacgagtccacagctatttggggacagggactgtaatacacacagcttccttttctcagtccagcacgtgggagggagacaagccagtatgcaaggcaaatgtggcctttggggtcaagcaagcttgggcttgaatcccacctgtctttgccacttactaaccatgtaatgttagccagtcacttcgttaacatttgaacctcaacttcctcaaagtaaaatgagcctaattacacctactcagaattgctacggaggaaaaaaaaaaaaacaaaaagttagacatttaatgtccctaacatagtatctagcacaatggtaagatcctgattgttataaaagttgctattatgattattatcactcttaatattcagtgctcagtaaatatttttggaatgtaataaaatgtctggttgtattgcttagttttggcttgagttccaatgaaataccaacaggccattatccccacatgccagccatctgtgcagccttcaacacacacttactgaagacaccagaaaggaaattcaaatgctttcaggacacactgtgggccaggcactataggaagtgttttccttatactgctttgctgaaggcccacacttctatgagattgctgttattgctgttattagcttgatgtctgcagaagagaaaactgaggctttgtggctggatatgtctttccttgtagttctagcagaaccagggtgcaaacatgggggcgtttgactccaggcccctgctctctccactgtaccataccattctttcttttttttgagacggagtctcactgtgttgcccaggctggagtgtggtggtgcgatctcggctcaatgcaagctccacctcccgggttcacgccattctcccgcctcagcctcccgagtagctgggactacaggcgcctgccaccatgcctggctaattttgtttctcttatttttagtagagacggggtttcaccgtgttaaccaggatggtctcggtctcctgacctcgtgatccgcccgcctcggcctcccaaacgtaccattcctttcttgtggaggcaccaagaagtagaaaatgtgagagttcccgacttcaggaagaatctagaccaatggtagagatcaggtaaattcccagagggagaaaagtcatagttcaaaatggcttatgataaaaaatgtgccaaacaacaaaaaacaacctgattaaaacatgggcaaaagacttgaatagacatttctctaaaaatgatatacaaacagccaattggcacatgaaaagatgaccaaaatgattagtgaatcattagcgaaatgcaaatcgaaactacctcaccctcattaggatggctgttaccaaaaattcagaaaataatgagtgttggtgaagatgtggagaaattggagcccttgcacactcttgataggattgtaaaatggtgcagctgctatgaaaaacagtatggaggttcctcaagaaattaaaaatagaactaccatatgatctagcaattgcacttctggatatatatccaaaagccctgaaaataaaatcctaaagagatatttatacacccttattcatagcattgtcattcataatagcctaaaaggtaggaacaaccaatgttcattgacagatacatatacacacacaatggaatattattcagccttagaaaggaaggcaattctgacacacgctgcagcatggatgaaccctgaggacattatgctaagtgaaataagccagtcacaaaaagacaaatactatatgactctatttatatgaggtgcttatagcagtcaaattcacagagatggaaagcagaatggtggttgccaggggctgggggaagggagaatgaggaattatttaatgggtatagagtttcagttttgagagataagtgctgtagattgggtgtacaacaatgtgaatttgcatcacgctaccaaactgttcacttcaaatgcttaaggagataaattttatgttatgcatatcttatcacaattaaaacaattttaaaaatgtattttaataaaagggaagcagagagtgaaaggcataatggttcctaacttcaaagaaaatctagaccaactggagggaccggatcaaccccaagagagagataagccatgtttcaggatggtttctgatcaagagcagtgctgcaatgacagcatgctactgcgtggctgggtttgctcacacacactgatcacagctaattatctgaatatatgctggctacttttcccattagaggagtcccacgtaattaggggacacaggttaccatccttgctttgggcacatccctgcccttctctggccgtcaatcttcctaactgtccagtgagaaaagtggtagctggtccgtaaggggtctcccatcttggacattctatggttctctgccagtggtcaataggaattccaagggaggtaggttctcgcagtaggcagcacctgctctagtgcaagtggcttgggaacatgcttgaagctttcccctacagcctcttaaaatggctggtcaaccttttggtggcagtcgcgaagccttctgcacacagcaagggttcagttcaacaaatgcctattcagaacctgctgtcttccaggaattataaagccttagcttcattctcaaaaaaaaaaaaaaaaaaacaaaaaacaaaaaacaaaaaacaaaaaaaaacatatattctaatggggggagaaaagtaagtaagcacattcttatagttctcaaggttttgttttgttttgttttttgagatggagtcttgctctgtcaccagactggagtgcagtggcacaatctcggctcactgcaacctctgcctccctggttcaagtgattctcctgcctcagcctcccaagtagctgggactacaggcacacaccaccatgcccagctaatttttgtatttttagtagagacggcgtttcactatgttggccaggatggtctcaatctcttgaccttgtgatctacccgcctttgcctcccaaagtgctgggattacaggcatgagccaccgtgcccagctgaggatttttataagcaccaagggctgaggcaagggaggccagggaacactttcctaggaaaatctgccaagactcctgaggaatgtctattcaatacctatctggtgatgataataaatagcctttgtgtagctcattaataataataatagctaacacttaatggcacttatcatgtgccaggcactgtttcgatgtgttttgaatattaactcattatgtgcacagcctgatggtataggaactactagtctactcattttacagagagggaaactatggcacagacagctttaggaacttgtcccaaggaaacaaggcaagtgagtggcacagccaggatctgaagccacactacgctgccttttacaatgtgttaagctttctaagttacttcctcatctgttatatttttctagcctcatggagagaggtgctgacgccatttggaagaataatatcctgaggtgcagagatgtaagagaacttcccaagatcatacagtgattagatgtggggcgggacagaggctccactcaggtctgcactgctacaaagctgtaccctctgggctgatggcatggctcagtgaaggagctctctctgttcccaaggcagaggctctaactgtcttcacctgggttcaaggcgctgggaggaaaatgaacatctgttgtgtaccccccatacaccagacacactgctaggctatgctaatttatgaaatcttcccaacaacccagaaaagaatgcaccattattttcaccactcacagatggaaaacaggcttggagagggaagatgacttgcttcaggtcctcaccatagatgcttggatgtctttctgttttcagaagcctcatgtcctattacttctctgagtagcacagagccgagggaattttgctacagatcaagtgcagggaggtatttggggaaaatagcttattgtgacattgcctgagcacttgactatgaaaccaggtctcctcctaagagcattgaatgtgcattaactcattccctcctcaaagcaaacctatgtggcaaacaccaaacaccaatatcatgcccacttaacagatggagaatctgaagcgcagcacgaagaggtgtattaacttgatgaaggtcacacggccagtaagtggtggagccaggaagcctggcacctgagtctcttttcttagcccttccgcaatacttcctcatacaacaaccatgtaaggtagtgtgacataggaaaaacaaactcagtttctcctgtgataccctctcaccacacaatcaacacagaacacttctgtgacctctggtcaccaagaagtgtgtggcaatttctctctggcagcaaccagttctctgggagatctttcagcagacaccagctgggtgtcctctaattcagttcaattttgacactatctaactggagatggtgtcagatcccacaggttgagtactcagtcccataagactgcctccaatttccactgccaattccaagccccaggttattaaacctgtgcttctgatgaccagctataaatcagggttcccacaatcccttccttgggtttcatgaacttgctacagcagctcacagaactcagggaaatacttatgttccctggtttattataaaggatataccaattatcaccagatggaaaagttgcacagggcaaataatgtgggaagaggcacggagtttccatgccctgtctgagcacatcgtcctccaggaacccccatgtgttctactctctggaaactcttgaacctagtccttttggatttttatgcacacttcaatacttagacagcattgattaaatcattggccactggtgatcaacttaacctttaagcccttctccccagttcagaggttgggggtggggctaaaagtcccaaccctctaatcttgtcttggcctttcctgtgaccagccctcaccctgaagctacctaagggtggatagccatcagtcaactcattagtatacaaaagacacttatcactttaatgataacaagaattttagaagttatatgcccagaaacagggataaacaccaatatatattaatttgcaggtactattatttcaccctttttttgaatactgggagattaagacttaaagaggtttaaagcaacttgtctcattacagaggaagggatcgagacaggatttgaacctgtacagcttgataccaaataacttgtgcctagcagtgagttacttattcaggggtcagggccaggccttcattagggcaggctggacatacggacttttccatgctgctaggtttaacaggctggtatcgcttccccatctcttgtcactaaaaactcaattagcagcttgaggctgtgtcctcacatcacaccttctcattgatcactcagactgtgagtgagaaagattttaaagctggttggctttgcaaagcatagagcagcaaccattgagcatatgcttctgtgggtatatatttattcagcttatgttgagtataattttggatggtatgcatattttattttttgttgcagagagcaatttaaaagaagaaaaaaaatccttctctgaatggagacagatgccatatatgttggaccctcaggggattgaaaaggatgaggttcccaagtccagtgttctggggacggacgtgggtggaaggaaactcacaagtgatgggaatccaggatcaactgcaacacccacagcaaggccagcaaggcactaaccacccagtccagggcagggcccttcaaggttttattcccaaggcctccccagtagcctgtctgactgttctctacatgctatttactgagtactaaatattgagtgatgggtgaagtgcacatcatcccccttaactttccccacaactccatgttgagatgctgttgtacatatgagaacacagatactacattgcccaatgtcatcaactagaacagcaggaatctgtgtgctgggaagccagaccccagaaccagtgctctcaaatccccaccaatgtcatctagtggttactggagtccttattttggagtcctgatatccatgctaccaattcctatctgagtgacaatgaacatgtcacttccctttctgagttggcttccacactcacaggatggagactgagataccattttgctagggtgttatcaagattcagagatccaaagttacacttaaaagtcatttgagacatttgttctttttttctaccccaccccctgcctaaaaggttctcctcttacccaggatgaactcaagatgtaacattttaaaatgagccttaggaaaaaacctgcaagggttggtaccagctggagaaaaataaatacgctcatgtgggtgccaaagattcaaaagagagaagcagcagcccaaaccagagtctacaccagagggaatcattatggaaggagaaagttcatcctatcattgtgcagaaaggaaggatccatgtgtgactctagggagtaggatccaaagcatcattttctagctctgtaaatagactatggactctttgctagttaggacacagtatctttctaatgttagggcccagaagagggtcttacacagcagtacttagttgttgagctctgaatgcagctaaaattcaactgtgggttgtctaataaccagtttttgcttcaaccaaaggcaagtttgatctagtttgataagatgtgctagatgctggagaatccattaccaacagtcaagaatcacataaaagagctgctctatgcatacctaagtgggaaaactgtaaaaaaaacatgattagcataaaagacagggtcttggccacttccagaagggaggacagggttacaattggaaatggaggcatggtgggtgtgttgggggagggcttatggaatgcaggcaatattctatttcttgacatgggtgatggtttaggtgagaattgcttaattcgtatcaaaactgtaaataatgttttacatatttttctatatattatattgcacagtaaaattgctaaacatctatctatctatctatctatctatctatctatctatctatctagttatctatctatcttatagtaaatctactaaaaggacatgtcaaaatgttagtagtagctatttggaggtgacatgactatgggtgatattgttctttattttttctctatatgtcctaaatattcttgtatgtgcatataataatttcataattaaaaaaaaacacgttttagttgaattgcttcattacctaaataaggcaacaacaaaaacgtgaaggtcagttccaccacttctgcctgaaattcctccaatggagaacctcatcttctccctaaggttcaatgtgcatgaaagaacagctctgcagagtaagttgaggggtgccaaatcccactggctcttatataggcctatctgcagtgtcttccccctctggaaccaagtacatctttgacttaggtactgtggcgggaaagggagatgccccagagagaatcaagtttaactctgaatttgtaggaaggacaggagcatagctgaggattcacagtaaacagagtcatgttgagaaacagggtcccttcatcacctcggactgtattatccccatgatcatgggcctgaaaaatcacctttccctttcagtgatgatgaagaaaatttctgaaaaccaaggaaagccagaaaaggctactaagtttcctagctcaacaagctcctctctacacaataggacctgatcttaggaagggaggccatggccctgggttttgctcatgcctggctactttcactgggtccggccaacaatattgtaaggtgcagggatcattcccattttatggatcagattagaggggctcagatacattcagcaatttgtccaaagtcacacagcttcccagttacagggatgggatttgaatccaactctgaattatggacaagtctattctttttactggactggaattctgattaactagcccatctctctctaggaacgtctgtcactcagttcgggtagaattttctcaatgaggagaaaggctattgagtgtttgatgaaaccttctcactgtttgctccctcaagggaaagggatttcaaaatacctgggctagtgggtcaagacttcttaaagcagggatcagagagaagctggagaatacaggcaaaaggatacctttattatttgtaaaatttaataacaataataataatgtcatttgtcatccatttatcctcaagacctatgataaaagacaaaagaatgatgataaaaataaaagcatgttatcctgggtggaagagagtcctacactggaatttcagacacctgggttctatccaagcatagctcttgtgctctttagcctcaatttgatcatctttatttattacccaaggggaaaatacacacacacacacacacacacacacacacacacacacacggttaagatcaagctaggaagtcagttgtcctaaaaagaaaaaaaaattggaaaagctctaggaaaagcagaatgtgtagttctgacttagaaaattgtcccgaagaaacacaactgtatgctttttatgcttccatttttaaaattacatatataaattcttatttatatttgcatatgcatagggaagaagtgtatggaaggatatgtatctatctatatatacaccaaaccgtggcacatttatctaaagtgggtgagtagttaagaaagggggccttgagtttttttctttatacatttcaacactgtacaaatttattttattttataatgagaatgagctacttttagaaaaccaaaaaaaatttttaaaggaagattgatgatcagatggagaaaataccttatgaatgcaaaaattctattattataattaagatgaacacaattattccagcttttcgtttcagagctaaggagaaggtgtctgatgatcagcattctgatgcctcaggagacactcactggtgcttggcacaaccactaaaagttctgtagtcatggcttctgacctcctcaaaccctcaaggagacagcagacccacggcctcatttactctcctctgcattgcctcttgtatctggaccctctctcacagacacagtgcacacctcactggactccactcccacatgtactacatttattttatcactctcctgatcagagaccctttaggccaaataccctagcccgcccttgggctgcactctgaaagaaaagcagcacctaaaacagtgtggagcaccagatgctctattgctccttttgaaaaaatccatcccacaccttcacccaaatcatgaaacactaatacaatttgaaaactgtccttacagacttctgggaatctcttctaaagaaacagctcaaaacacagaaggtggcttctgcccaaaggtgctcagagcagcacggtttataatagactaaatctggaagcaatcaacatgtccaaccagaagacaaagcaaatgctgggatgttccccttcatgaaatattaggcaatattagtgatatatatgaatttgtcctggttaagggttttgttatcaacctgctttggcccaatttggcccgaattccctgctctagaactgagtagctttgtggtcctgagcaaattacctaagttttctctggctcagttttcccatctgtaagaaaagggataataatgagatccacctcagaagccttgaatcatagcaagcattcaaacaattttagctctcatcattgccaccaccaccatactcaaccctgcatgagatatcagataataataatagcaaccatgttttgtgcctgcttagggccatgttctagcccattgcgtatgcattctcagttagtcctaacagcagctttggcaggcataagtagtattatccccattttactcaacaggaacccaaggctaagaggctttaagtaacttttcccaaagtcacatggctagtgaatgacaaggtaagattttggcccaggtttctctgatgctaaaaactgtgtacttaagcactatagtgtcttcccaaaagtaggggatggtagtgggagatggtagtgggagcagtgatttatgcagggcttgcagacaacagttgggaaaactaggagtgcagcttccatttcctgcctccaatttggggcttccttctctctttttttttttttttttttgagacaagtctccctctgtcccccaggctggagtgcagtggcaccatcttggctcactgcaagctccgcctcccgggttcacgccattctcctgcctcagcctcctgagtagctgggactataggagcctgccaccacgctctgctaatttttttgtatttttagtagagacagggtttcaccatgttggccaggatggtctcgaactcctgaccttgtgatccgcctacctcggcctcccaaagtgctaggattacaggtttgagccaccgcgcccggcctcccttctcattattccccccccaccattatttcaggaatcaaagggtaaaacccatcactttggaaaaaggggggctgcttcctgactttaacagataatgacttccacacaataaaaccagcttaccagaaataccatcagacccagcaaatccaagtcccaacgaaataaaataaggggaaaaatagagaaggcttcaaatgtcatgagaagaaaaaaatatttaatgtcataaaagggtgcataggctttatgagaatgccacacacaataatcttggaaaccctattaccccacctacccacccagcctgctccaaattcataaaggaaagatgcaaatgcactgattggaaagatgcaaatgctcctgattgaggagctactccctccttttcatttcccaaactttgagtcctgtgtgcaggcattgaatcagtggacacagtacagttccaattcccttctttactggctattcttatgtccttttccaatacagttccaatttccttctttactgactattcctatgtccttttccaatacttagcctctttagcttcctctggatctcttggatgcagtggaggagaaataaatactggacattgatagagggtaaagagaagaaagtgcccctctcttcatgcttcctgacattggggacattcgccttatccctagggaactattctcagccttgggagggtgtcttctgatgaattaagagaatgagctttggagtttgacagagtttggagtttcctctgcctttacctggctggttggatttgggcaagtttctcatactttctgactctatttcctcatggataaaatgggagtaataataatgctttccttataaggtagctgtgaggatttccagggccaggcacataattagtactgaaatgttctctctatatatccgtatcagtaatactaggcctgatattatttatagcatttattcatttattttttagtagctttaataatattaggcctagtattactgatcaaggtattcaatacatatagagaattctctgtctgtgaacctatttgactagaggatactttgatgaagacaccatgggggcgatatgtcatcctgtaaatcctgttttgcaacccaagagcctgaagttattcccataaagacacctgcctgctgcctttgcatctttctaataatttttaaaaagaaaaatagggcaaccatcagtcctctcattttggattttggcaaaatctgtctcagttgtcttctgaatctatcataccccatgtggctgatctacagggataaatttagctttgaaagtccatttctggaaaggaaaaacaagtctccaagggctagatcccatggaggctcagcccagctgcaccgtgtaggagggttacatgcccaggcaggcagggctgggctttccctggtcagcagtgcctgggctgtgctccaaggtgatttctcactctgctgactcttcttgctagtcttccccacccctcttgagttttgttcctttaattacactgcaattgagtcattaagagggggaaaggatgaggaatggagaaaagccggtctctctcccctactgaaccagattccagcttttgcctccctctgagcagtgctataaggttcctggcctatactaaatggaaatccatatgtttattcatcttgacttttagaaaggcagctcttgttgttgtctctcagcacctgtgcaatcagggatcctatgatctttcctaatatctggcaggccagatggttttttagatcaaaatgaaaaaagaaaaagatggggcagaggcggcagaaatgtgactgggtgatttgtagggttgaggagtgtgggattggtttgagattgttctagaattcagagccagggctaagaactgaccacagaggctcctcctgaaagacaccatcactctaagacccagcgagtatgcaaatccttccacttcccttagtcctttctatgaaggccttgactattcgatgttgcccctcctttctatcctttcccattatttttctccacatatcccagtttcctaccagatagtttcatttttctcatgtgtgaagtgaaggtaataataatatctggctcatattattactgtgagcataaggttggttaaaagaagcaaagcacttagaaccgtgcttggaacagtctttgtatggatagttgcttttatattactagcttttcttttttgtaaaatggacatgatagttccgggtaggtgataattataggcattaattgccatgaacataggcaaaataacacatagtaggtgcccagtgagtgccagttctctcgtatgaccactcttttctctgcaatattcacaccaatcctcttagagaattttcacacagagaaacaaagtggtttgttcaagattatgctgcaatcctgctgaagtctgtcttgtcttctgaaggggcttataaaacaaggcttaactcttgtggtgttttgctcctggtccattcacagtgctggatacaggaatgttgcgaaataaataattatactatatagtgacaaagctgatgctatggggccattaggtgttggaatgtgaaactggaagggagtcttggaattaaatctaggttgtattactacctccctacatgaacttgagcaatttccgtatctttctaggcctttgtttttctgtttgtataatgggagagggtcctttctggctctggtagcccttgtctgtctccatgcaatgggtaaatgggtagattaaagatgatcacacattctttgctactcttcgcattgacaggtgaaatctagctctttcccccttgaatctgggctgaccttattgacctgcttgaccaatagaatgtggtagaaatgatgttctgagacttctgaggctggggactaagaagccttgcagcttctgcctaggcacttagaacgctggatcttgggatggtcccttggtaagcccaggttccatgatgtgagaagcccaagccaaatggggagcccaagaaaaaatcctctatccagttgacagccccagctcaggtccagcatagccagtgtcaaccaccaatggtgccagtcctagccccagacaggtaataaaggaacccttctgcaaatgactccccagtcccagatgccccatctgtctttgatcagagacaaaccagctgcaccctccacatagtcctgattcacaaatctatagacaaaacaagagtgtgtgaagctactgagttttggggtagtttgttataaaacaatagaaagctggaaccaggaaagtgagctatgaactgatacttcaaaaagggttaaggaggacgcattgtgtttaccagattgtctggtgttgggttaatcaaaaggcttcctgtgctgggaaaaccagaaaaacataaaagaatggcattagtgaagtgcgtcagggggcagcagttacttagagatggtggtggaagtgtcctccatacgatgctgtgattaagtgcttacagttttctttgtttttattctctatcttgattaaaattttgcagtgtttatactgccacacagaataaatggacccatagcttacatttcaaactgtgccttgctgacatcattatgtttgtcagatttataacatttctaatatacaacaatttttcactcttggaacactgaaggggaacacaggctccctctcttttctgatgtttcattcactgttacttcctctatcactggtcaagggatatggtctccttggaaataactgaaaacaaaaataatagcataattatttatatattatttactgtatcaccctcctcatatgatcttttacctgttatcagtattttattgctattgtagcaaattactatgcaattggtggtttaaagtaacgcaaatttattatctcacagttctacaatttaaaagtctaacttgggtctcaatgggctaaaatttaggtgttggcagggttgcattcctttctggaggttccagaggtaagtctttctctttgcttttccagcttctaaacaccacttctcttccttagcatgtaactctcttcctccaacttcacagctggcaacgctgcctctctctaccccactcctctgctttcctgagcacactctgataattcaagatattctcgctcttttaaggtcagctaattagtcatcttaattccttacgcaaatttaaatcctggttctgtcatgaaaggtaacataccagtcacaggttctgggaattaggatgtggacatctttgcaggggccattattttgcctactacacatcttatggccatcctccaattggccaattacctatatgagaaacatattatccaaagggaaggttaccacagcagaaccagaaagctgagcaaaaatatgtcagattttttaaatcttgtgtttcaaaagttgaggtctagaaggtagagctattttagaaggtaaaataataatcatcattataatgacaataataaagcaatagaagcatctgtgatctgttagagaattaccttcccttgtatccacaaagaagtaaaggtcatctgagctggtggaagacaggaatgttggaagtcaaacaaagtaatctagaaaatgctaatgagtgttctaaaaggggtcccatcctctatccttaccaggctacgcccatgagtgtatgaaggggatgagggggtgcagaatatcaggtgggtttgagggctatgaaggcaaaggggttctgggcgtcacttgctatatagcacaggttgacagcaagcatggtgagtgatcctccccactgtgaaaacagccaactacagatcctttcctggcatgtctagatcaaaagagctctagacagctttcctcagatcctccaggtggaactgttggacatttctcaggccctctggaggctggaaaaactagctgacgcacagagccagctggccttaaatgaccttgtggtggaataaagtggatgaggcagcagctgtactacacacctgtgagtcaggtgggaatggagaggaaggagagtgatggacaagggccaagtgatgcagcaggtaccagattaaaaagtgatggcccagcatcaaacatgcccttagctcctaggccttacaggtacattggccctttgagctaaaatgttcagttaagaggtgggaggcagaaaaaaaactgaaattgactagagttaagtttccactaacaatggaacagaaatgaaatgaaattcagttacagaaacgtaatagaacattagatacgctgtgctcctaaatttgtgtggccccaaatatatccactacatacaaatatcagtaatgtggtctccttatctcactcataaatggtactttgtaaatcccaaatcattgccagttatattctttgagctctttcagttttttgtttttgtttttagaaaaatctgtaagtactgttgcttccttttgaaagattaagaaactgatgctaatgaagtcaacatagactccaaagctatggtcattctaatgcctaaatccaggctttagcccaattcactcagcccagcctcctttccatgattcttcaacgagaactcatctcagctcccagtgtgggaaagcaagccaaagtggccctggcagaaggactgatagtgagacatggtcttggtcctccaccctgccacctggtggtaagaccttggaaagtcactctgcttcctgagcctgtttccacattcctgagggaatctactgcccaggtttgttgtgaggatgagctcttagcttgtagacatgctttgagaatgctaaagtattctaaaaatataaggaattatcatgtaatacctgaaggaatgtcttagaaggtgagctatgagaagaagtttctctttacagacatgatggagagtctacagagaaatgaaagggatttaaaatctcagcataaacgtggtatttccctgtctattctgaagcacagagaggagcttgccttacatccattgaaccttgaagtagtggttttaaaattacatcctcaatctagagaggagggtctttgacaacttcatcagaccgttgaatcttctcttatcccctagggaatgaatgttctttctctttctctctcttttaatttttccagtttatatgaataaaagacaaagagagacaagcccaagctacacacacacacacacacacacacacacacacacacacacacacacactcctctgtatttgaggtttcattcctatgggatatctatcctaaaagagaaggagcttaattaatttgagaaaagagaactaatggaaaagaggaaagaggcagacaacttaatcctttgaaaaaggtcagccttacattctggacacaacacagaacatccttttgagctgtttgtccactggctgggtttcagacttcagcaaatcctcctctccccaactagcacttttccaatgtgctatatgaagggttaggtttcaatggtctgaggcagacagctgttgatgtatatcaatctagcatctacaactcctgttgccagcaccccagtttttcttgagagtctatgccttcccccatctcagggccatgcatttcaggtgtagctgcctcctggtgcaagctccaagcatggctgtctctgggatgagcccagttaatccccctgaccagcaattggtgcagggataaatgggcatgagaaccaagttggcacaatgagaaggaatctggtgacagtagttggaggtactaggaaagaagtgtttttgtcctgtaggacttgcatccagcctgcagctggcccaagaatggcacagtgctaaggaaagcagagctaagataaggagggggattccaatgacattgcttgagtccttcaatccaattttctccagacttccacttaagccaatgcatttccttcttctttttttttttttttttgcctatactagtttgagtttagtttctatcacttgtaatcctgagaattctaatcactaaaatttctaattgcccattcacatctgaagagctattaatctttgagtctcagatatagtttcattgcattatttcattctagaagcttcttcgtattgatctcctgacctttgtctgtttctcagctggtgtgtagctgcactaagggccaagtgtgtgttctgtctcccttgggtcttgttcagagagcctagtccagagcaggattcctatccctggttctatccttcccttcttctttcttttttctttatttactgagatgggtacttctggggtgttgagccgaatcaacagattccctgggttctccctcagttttttaagaaacataaactgaaaaaccagtctgtgctataacgtgtcacaggtgacttaataaagctaagtacagcatacagtaaagatactgtatggaaaagagggtcacctgcggggagggaaaaggcttcataaaggagatgtctctggaaagatgttcacttgtttgcttcatagacttcgaaagcaattctttctaggcagagagaaggtacaagaaaaggttctgaggcatgaaacatgcaggcaagttcatagaactccatctaatcagctccattaggctgtagtgtagattgaaatgaagcgataagagatgtggctggagaaactgaaaagggaccacagaaagaagagcattgaatgccaggctgagtttagcctatgtggcaatgtttcccaagtgtattttcaagataccccaacacacacaaatacacacacacacacacacacacacacacacacacatacacgttaaaaagtcaggctcccgggacctaatctcctctctagaataaaagcttctagaggtagaaccctgtatcttaggtcattcttataaaaccatcagttttggcacacccttctaaagcaacaggaaccctcccgcatcttcttgtgtgaccttgtcccacgctagatactaaaattccaagcaaacaaggctgcctctcccttccttcatgtctttgcttggctgtctccgctctttccctaatgtaagttgactcatcttttgaagccaaagccaaagccaaaagccaacgtcccaaggaagccttctacgaaactgaggtcccagctgaaactttctcttccggaccacaccaaagcacctgtccatactagttacacctcattgacatcccgcctactattgtattcacagaggtaaggcatgccctgtcttactctcaaatggactgtaagcttctgaaggtcagaagttctctaagacctattgtgtggtgggcacttaagttataatatcttgtttcattcttccaacaattccaagaggtaggtttaatgatctcactttacaggtgaggaaaccaaggtaggctggcatactgaaggccgcagaggcagataagggtagtgtggatatgatcctccttaccagcgttccctcgcagggcagggcttctagcaggtggccttagcccctgggccactgccatgttcccgggccaatgggcacttaccacacatcccgaggaatccacctgccggtcagacacacacttgaagttgcgagtgcagcccccattgttccgagagcagtcacgaactggcccgaaggaagacagcaggtcattgatggtttcaaagtatgtggacagcatcgcttcttcccttggagagaaaggggatggttaaaccccagagacatttggatccttagattaaaaaaataataatgtgaattcattacatttgaaaccataacttacttataatcaggaaaacaataataatcaatattataaaaaggaaacaacaacaggtataccatcatatgacacggtgcttgtcaagttgtgatacagagaaatggacctagaactctatactctttattttattaatacttatgattcttggaggtagtcatgagatgtgcactttaccgtaagggaactaggcttagcaaggtgaagtatcttgctgaaggccagcagcttacaatgtgaccgaagtgaagtttgtattaacttccagctgagtccaaagagaaggctcttctcactgcctaactcttagcttgcatcctacctgtttctacagatttcagagctccctatagcaactctgcaattgggcacatccctattattccaactttgtgaatataaaattgaaaccatgaaagattgtgggactgactccaaatcccacagtctataaatagcagagccaagacacaaacgcaggagtctgaccctccagggccctagatccttatttttcagactattgtgtataagtcactccatcaagactatcagcaacagttgttggaaaggtcatgggattccagggaaatacgtgattcctcccaaatgaggttctcaaaagataagactagacttgataccataatccatggatctgccaacattttatgagatggaattctctacaatggaggatacagatgggagcctctgatgctgtcttctgcagaaagggcccgaaataagagatacatttgctctggggtatatgattcccatacttacaggagattttaaagaagcaccatgggcagtgagaagcggcacatatccttccctggtctgtgcctcatgaggcccagagctgtgaagcaagggaaatgcctgcagccacacatgaagcaggaagaggctagcaaacactagagggggtgtctctgcaccatcttgcataccttctcccattcttctccacctcaggcttggaccaggtttgaaactcctaattcatttcctgcctccagtcttatcccttctgtcccatctttcatactgactgtcagtgaacttggtaaatcccagctctaattagatactcctctgatcaatagcttcccagtacttagagaagaaatataaattagcttctctggcattcggacttcataatcttgcccccagttacctgtccagccacatttaccctctcctcacatctctatccactaggcacaggcctcgtctcattccctgaacacagaatctctgaaaacaggttctaaactggaaagttacatgcaggaggtttattgccaagccctcttgggagatgcatctaaagatggtgaggaagggctgggcatagtggctcatgcttgtaatctcagcactttgggaggcctaggaaggaggcttgattgagcccaggagttcaagaccagcttagaaaatgaggcaaaaccctgtctctacaaacattttttaaattaccagggtttagaggagcctgcctgtggtcccagctactcgggaggctgaggtgagaggatctcttgagctacagtgagccatgatcaaaacactgtctcaaaaaaaaaaaaaaaaaaaaaaaaaaaaaaaaaggcaagcgaagaaggcaggatttggtaaagagagagactgatctacagtgcgggtctaaagtatcagttgttcctgcagggagctctggagctgagaaggccctttatggatgtcctgaattaaagcaaggaatccaggcctttgcatccccacagtagccagtcattggtggggctgctgtctggaatgggatatactaggataaaccagttccctgaggctgaaggcaatgcctagtcactgacagccacagctggtgggtgggtgggctggccctgaagaggggatctgtgtgtggtacctgcaggcacctctctcaatcccaaatcatgctcttccttctgcctgggatgcccatttccaaatgcttacgtgaagaaatcctaagaatctttgaaaactcttcatattcattcattcattcatttattcattgtacaagcttactgagtgtttaccatataccaggcacaatgctaggtgctggggatacagcagtgacatcaggcaagatcctgactcccaatctccacagtagctttatgttaccgcctttgtgaaaccttctctgttaattccccctactagaattaattccttttccctgtgagcatagtggctaaatcttttaacttattgatcttaattatcagcttcacagtctcccagagagactataagcttttaaaggaaaaggctcaagatttattcatttctctttagtccccagcacagtctggaaggaaagtgtgctaggtaaacattttcaaatgaaacacagaaaacacccaaaggcttagacgcagtcttcaccaatgagtacttttactaagaacctcctcagcagggcactcctctctgtctccccaactctgggtccccattccaaatcctttgtgttcagggatgcagcacagggacaaaggagaagggtgaggtgctacaggattatcccttgcttcctaactttgtagggagtgaggtgacaggtttatgggaggaaagaattaatagttcctgaaatgaagctctggggagacttgccacttttgaatcatgaagagagttgaggatcctgggaagacattaagcctattaaaatattaataccctagaagggagaagaagaaacagaaagtaagaggaggagataaggcagagggaccaggctgggcgtggtggctcacacctgtaatcccagcactttgggaggcctagatgggctaggtcaggagatgaggactatcctggctaacatggtgaaacctcgtctctactaacaatatagtagccaggtgtggggcatgctcctgtaatcccagttactcgggaggctgaggcaggagaattgcttgaacccaggaggcagaggttgcagtgagccgagatcgtgccacggcactctagcctaggtgacacagcgagactccgtctcaaaaaaaaaaaaaaaaaaaaagacagagggacctgagaaagtgagagaacaagagataaacaggtagagaaactgctgagaaggaaagaagagacacagagaggcagaaacacatatagccacctggaaacagataaagggatctaaaaggtatagatggacagacagagagacagagagttatagagggacacaggtcatagagacagacaggaaaagaaaggcaaatagaggagagaaaggatgtgaaaagataaaaatgaaaagatagaattggaaaaagaaagcaaagagagaaacagaggcataagaaacagatgaaaagaggaggcatactcaaggtaaacagaacaaatgtgtaagtgtgccgaggagagggagagaaggtgggagggagagtgagaaaagagagcaggaggagacaaatgcagaaagacagaatgaaagggaagagaaagacactgagtaagaaagaaaacacacccatctctactaaaaatacaaaaaattagctgggcgtggtggcgggtgcctgtagtcccagctacttgggaggctgaggcaggataatggcgtgaacccgggaggcggagcttgcagtgagccaagatcgcgccactgcactccagcctgggcgacagagcgagactctgtctcaaaaaaaaaaaaaaaaaaaaaaaggaaagaaaacacagagccatggagagcagagacagacaacaacaaagaaacaaggaaagggaagtgaaaaacaagcaaaaacatgtcacctttctctggaagctagagacagttcaagctataaaaatacaaaagctgtccacttttaaaaggattgattctgcataaacatcagttacatgaggggaacattacttaaaacacaaagacctgacacaggggccgttactaagtcaagagaagtgattgtgtcaggctagggaatgaagaatctgagcgcaagacaggaaaaaaaagcttaaagcagacactggcgttttcttaactcaaagcagacactggcgttttcttaactcgggggctcaatccttcatctcacttgcggagcccagggtttagggtctgtgggatcttagagctgccccaatcttggggcggggagtgggaggcagcaaagagatgaatggaagagcactgggggcggaggcaggctggactgagacactgccctggggtatcaggataccagtgtgagaatcccagctttgccagcaatcaccaaaactaccaacatcctcttcattatttaggatttcctgggcacctgctatgtgttaagcatggtgcaaggttcccttcctgtaatattccctgtgattttcacaagagccctagaaatgacagttttatacccaatgtgcagctggagaaacaggggcttagggaagttatgtcacttgctccagttctcaatggcgtgatgcagtgaggccaggctgtgcactcgaatctgcctgacctcaagtcctgagttaaactttaacaacttaccctgtgtcttgggcaagtcagagccctcctaacagtaaggcccgtaagaatgtgtgttcaatctctctgtcttagcagaggaggacagaatgggcagagcctgagagttctttgtgtacctcccacagcctgattcctgggccatgcatgtggtccacaatagcctcaatccatgcaggaatagaaggggaaagcatagtgtttaagtttactagaagggccataacaagtaccatgaatcaggtgacttaaaacaacagaaatttattctctcgccattctgaaggccagaagtccaaaatcagggtttggtagagccctggtccctcagtaggctcaaggagagaatccttccttgcctcttcagagcctcccatggctcccagccatgcttagctttccttggctggcagtttcaggactcctgcctctgtccccatcatcatatggccttcttgcctgtgtgtctgtgtgtcctctcctttttttaaaatgacaccatttgggctgggtgcagtggcttacatctgtaatccctgggaagctgaggcaggtggatcacctgaggtcaggagttcgagaccagcctgaccaacatggtgaaaccctgtctctactaaaaatacaataattagcagggtgtggtggtgggtgcctgtaatcccagctactcgggaggctgaagcaggagaattgcttgaacctgggaggcagaggttgtagtgagccgagatcacagcattgcactccagcctgggcaacagagcaagactcctgtctcaaaaagaaagaaagaaaaaaaaatgacagcattagttgggtttagggtccaccttaatctgttataaccttttcttagttatatctgcaaaggccttgtttctaaataaggccacgttctgaatttctggtgaacacaaattttgggggacaaaattcatgcaattccacagggcacaggggaatgtgctcacattcgcatggtaggacagagccaggactaaataaaacacctcagtccttgattcttatcaaagtgttcctaatactgcactggctcttctcactctagacacttcatgtttcattgtggtccttacaaggtttgaaaaatcttagggaaaggatcatgatgaagtcactctccatattatctgtgcctttatttgggaggagaaaagaccaactttaattaaatacctaccacactccagcaaccgtgtagagggttttcaaccactctacagaacagagcttggcaaacttttctgtacagggctagatagtaaagatcttaggctttgcaggccatacagtctctgtcccaatcactcaactctgcttttgtaatacacaaacaatcatagacaatatgcaaaagaatgaatgtagctatgtttcaataaacctgtattaaagatgggtgtagtggctcatgcctgtaatctcagctctttgagagactgaggtgggaggatcgcttgagcccaggagttcaagaccagcctggacaacagagtgggatcccatttctataatttttttttttttttttaattagccaggtgtagtggtgtgtgcctgtagtaccagttactcaggaagctgaggtaggaggattgcttgagcctggcaagtttggggaggtgggggtcaaggatttcagtaagctgtgagcatgctactgcactccaacccatgtgacacagtgagaccctgtctcaaaaaaaataaaaaataaaaaatactgtatttacagaaagacacagccagataaattattttctgttttaggtgtgaaaaccctgaagtcagtgttggagttaggagttgaacccaggtaggtccaactccacattctttctcctacatgaatcttctgaaactcagccttctcatctgtaaaatgggaacaatatctgtctaattctcagctctgtagatgactatgaggatataataacatgatatagaaatgtgttttccaaactctaaaacctaatgcaaacttattcattgtttattcattcaataaatatctgagtacctgctgcatgccacatactgagctgattattattatggcttttctttggcctcccagcagctgtttctgttcctatataacccagacattgtgcaaaaggttccaaacatctctctatctctgacatacaaattattattatttttttctgttaatactggctccaaaacagagatagccagaccccaccagactgggtgagacagccatcccctaattacctgaccggtaaagtacaaatgcgtcacctggattccatttggctgagtcagcccaagcctgatgcagggtgagcattaggcagggtggctgggaacagatgctgacatggcctgctgttaataaataccaggaaaggtctgtgtcactcatagagagatgtgaatggatgatgccaagccaagacagtgacaagtccctcactgatgcagattaatcattctctggtaatagccgacaaccttgtttcctgagctacctgggaaggaggaacctaagacaatgtactgataaaaatcaagctcagggcaggcacggtgcctcacgcctgtaatcccagcacattgggaggccgagacagacagatcttgaggccaggagatcgagaccatcctggctaacatggttaaaccctgtctctactaaaaatacaaaaaattagctgggtgtggtggtgggcacctgtagtcccagctactcaggaagctgaggcaggagaatcgcttgaatcagggaggcagaggttgcagtgagccgagatcgtgccacggcactgcagcctgggcaacaaagcgagactccgtctcaaaataaataaataaataaaataaaataaaaaatccagctcagtttttttattttaaagaaagaacgctttgttgagatataattcacataccatatgatttacctatttaaagtgtacagtttaagcagggtacagtttaagtgatcaatatttaaatattttcatcaacccaaagagaaaccctgcctctatcataagtccctgcctacttcctcccaatgacccttgtgttgggaaaccactaatcttctgtctttatagatttactaactctgaacacttcatgtaaattaagttatacattatgtagccttttgtgactggctactttcagttagcatagtgttttcaaggttcatccatgtttcagcatgtatcactacttcattccttttgtattgccaaatgatattccattatatagatattccacattttattcctctatcattagttggtggacattttggttgtttccacttttcagttactatgactaatgctgctatgaacattcatacacaggtttttatgtagatacatgttttcatatattttgtggctccccctgccctgggatttagggagccttctcagcccctaatagcatgagccacagtgtagaacagtagataagagggcaagtttgtctggagtcagactgccctgaggaggaatcccagcttcactcagtatgagaccttgggcaagcctcttctttttgagacagagtctcactctctcacccaggctggagtgcagtggcgcgatcttggctcactgcaacctccgcctcccagttcaagcaattctcctgcctcatcattccaagtagctgggactacaggaatgtgctaccatgccagactaatttttgtatttttagtagagattgggtttcaccatgttggctaggctggttttgaacttctgacctcaggtaatccagagaccttgggcaagtctcttaaaccctgagcctcaattttctcatctgtaaaatggggatattaatacctaactagcagaggtagcatgagtgatagattagggagcaaatgtgtcaaatgccaggcacacagtaagtgcctaacagctggtaataagtggtatcatctgaaagtccctcaaagttgcaagaaccatgccttgagaatgttgagaagctcaatgtaggagaagggatgaaagatctgagaccccacatggtccatttactcagttaaaaatgtttctttggtgctaggcttgttctgggtactcggctgggttcctgggagacacaggaatggatgtaacagagcttgtgctaggcaggaggaaaaacactaagctagcaagataagtgaggccacaggaccacaaagatgactctctctctcttgccagaccttggaagtaggagctcagagaaggctttttggaggaggtaatgttgagcctgagacataaaggatgggtggaaattaggtaaagggggataaatagagtgggttaaagaaattctagggagaaggaaagaatatgctaaggcctagaggtaggagatagaataccctgattgaggggcttcaagagatgcagaaaagctggactgtcaaggaggaggtgagatatggcaaaggctgaagcagaaggagtgccaggagccaggctagagaagattcctgtgtgccaggccatggtgattctggactttaccctggaagctatggactgccacccaaaggttaaaaagcagatcctgcttttatttagagtaatatcatagatgaatagtttacacaaatccttatggcaataatagttaatgctgattgtgcattcataatatgccaataaatggtttaagcactacatgtatcaactcacttaatcctcccccaaaacacaatgatgtaaatgatacatccccatttcataggagaaagaaactcaggcaccattttgaggctgttttgagacctgttaaggataatgtaggtaaagcattaggacagtgcctggcacatggtgactgctttataaggatttcttgaaaaacagcttccaggggagggatagggtgaggtggcacaagccacaggtaggtagatttgagcttttccaaagccagagacattcagcaagggaacactgtcttccaagttactgctccagccttcaggaatgcatactgaggaggcatggccattttcctgggatagttgtggcgggagtcaggcctccagtgcagagggtgtacaatatcatggtgataacaacattcacatgggctaattatctactgagaatttatgacatgagaactttggcttaacatagattatctcatttaataattgcctatgggattgtgctattatccctgttgatatggtttggctgtgtgtccccacccaaatgtcatgttgaattgtaatcctcaatgttggaggaggagccaggtgggaggtgattggatcatggcagagtggggaggcagtggacttccccattactgttctcgtgatagtgagtgaattctcacgagatctggttgtgtaaaagtgtgtagcacttgctccttcactgtcttcctgctgttccagccatgtaggacatgtctgctcccccttccccttctatcatgttgtaagtttcctgaggcctccccagctatgcttcctgtacagactgtggaacactgacccaatgaaacctcttatctttataaattacccagtctcaggtagttctttatagcaatgcagaaacaaacgaatgcctctgttttttcaatttgaaaagaaatgtacacactcagatgcaggacttggcatttacagaggtgagaggactggcagtgagtcctagtgacagagctgggttccaccctgggtgtatctgacttcggactctttagtgtcctgcctttctctttaagaagtctttccacccagagattctgggactggtgttttagctgacacttaacattctccttcctctagcaattatggtttgcactaatttaggttgatatatatatatattgctgttcagagtggtctcataacttcctgggagtgtcttgtgcttctgagtagcttgttagcttcctgcatgcctagagtcctcctcggtcacatcccttagtgcactgggcatgctgcagctgttcgctgaataagggcaggtgttgaaggaagagaagaagggcacaataaggcccatcagctgtgcagtctttagaacaaagagaaaatgattgtaatgtctgttgtccatctgtgtgatggaggcaataatattcaactcacagaattgtgggtcagaattcaaagagttaaaagatatgaaagtctcttatcaccaggctcaaacaaataaagatcctcaataaagagctgttgtgttttggaaatgagtttgtgcatttcacagatattgacccagcactcacccctggagttggaggttgggtatagacacagcctcgttttattgtacctcactttattgctcattgcagatattatttcttaaagattgaaggtcggtggctaccctgtgtcaagagagtctatcagtgccatttttccaacagaatgtgctcacttcatgtctatgcatcagattttggtagttctcacaatatttcaaaattgtgttattattatatcgtttatggtttggggagccctcattgcgctcatataaagcggccaacttacttggtaaatataaggcctccctgtttgctgagacaccacaatattgaaatcaggcctattaataaccctacaatttcctctaagtgttcaaatgcaaggaaatgtcacacatctctcactttaaatcataagctagaaatgattaagtttagtgaggaaggtatgtggaaagccaagactgatgaaaagctgggcctcttgcaccagttaggcaagatgtgaatgcaaagaaaaagttcttaaaggaaattagaagtgctacttctgtgaacacacaaatgataagaaagtgaaacagctttatttctgttatggagaatgttttagaggtgtggataaattaaaccagctacaatattcccttaaacccaaactaggacaaggtcctaattctcttcaattctatgaaggctgagagaggtgaggaagctgtggaaggaaagtttaagcagagattgattcataagttttaagaaaaggagccatctctgtatcataaaagtgcaaggagaagcagcaagtgctgatatattaatagaagctgcagcaagttatcaaaaacatctagttaacataattaatgaaggtgactatgtccaacaaccgattttcaatgtagatgaaacagccttgtattggaagaagatgccatctaggtctttcattgctagagaggagaagcctggcttcaaaaattcaaaggacaggctgtctctctcattaggggttaatgcagctgttgaagccaatactagtttaccattataaaagccctagggcctttaagaattatgctaaatctactctgcctgtgctctataaatagaacagcaaagcctgaatgacagcacatctgtttacagcatggtttactgaatattttaagcccactgttgagaactcctgctcagaaaaatgagctgtgatggagatgcataagaggttaatgttgttttcatgcattctaacacagcatccttttttgcagcccatgcatgaagaagtaatttcaagtcttattatttaagaaatacattttgtaaggttatagttttcatagatagtgatttttctgatggatctgggtaaaataaattaaaaactttccagaaaggattctccatcttagatgccatgagaaaaatttctgatttatgagaggaggtcaaaatatcaatattagcacgagtttggaagaagttgattccaaccctcatgaatgactttgaggggttcaaggcttcagtggaggtaataattacagatgtgaaaattgcaagagaactagatttagaggtggaggttgaagatgtgactgaattgctgcaatctcatgataaaactaatgagaagttgcttcttgtggaggagcaaagaaaagtggtttcttgagttgtaaactactcgtggtgaagatgctgtgaatactgttgaaataagaacaaaagatttaaaatattacataaacttgcttgataaagcagtggcagggttggagtaaattgaaaaaattcactttcaaaaagttctgtgggtaaaatgctatcagactacatcacatcctacagcaaaatcttttgtgaaaggaagaatcagttgttacaacaaacttcactgttgtcttattttaagaaattgccacagccacttcagccttcagtaactaccaccctgatcagtgagcagctgtcaacactgaagcaataccctgcaccagcaaaatgattatggctcactgaagattcagatgaccattagcttttttttaagcaataaaatatttcttaattaaggtatgtacattattttttaaacatgatgcaattgtacacttaataaactatagagtaaaaaataacttttatatgcactaggaaacaaaagtatttgtgcaattcactttattgtgatatttgctttattacggtgttctggtacctaacacacaatatctctgaggtgtgcctgtatacagaaaagagcaaaacaaacatgtgctttgtccctctggggcttacagttgttgggacaagtaagttcctcttcaaagactcaaatttctggtcataaattgtaaaccaaacctatcccctccttttttcacaaatcgcacatttaccctatttggaaaagtttaagtcttagccaacgggatctgcttagattgtgcggtctaaccccagccaataggggaaggacacagaaacaggaactgcattagggttaaaaaccccttccctcctttgttaggtgtgctcttgctattgtaaccagtgcaagcagcacccttctgcagaagtaaatgtgccttgctgagaaattttctatctaagtgtgggtttttttttggctatgctgagcacttgtttccaacacaggtagttattggaacagtcactcaacaaataactgccttaatatcaatatgtgtgtctatatctatggctatagctatgtctatgttatatctgtatctatgtgtatatatctatagctatacatctatgcctatgcccctatctatacctaaatttataattacaaactgtgatagatgctttaaaaatactgaatacagtaagatcatatggcagaggggccaatctaatctagggatttggggatgggagtgtggagtgaggcagatttccctggagagtatgagaccctgaaaccaaaccagcctgtggtatggtgaggtttcatcacacccaggctgtccccaggagagctgggatgatgtgtatcctccattcccacccccaccatgcacagtgatcatggagtccatcattcctctggcaaaaaaagccatcttctcctcctgtacttgttctgaccatttagtcatagaaattctcctcttcacttaaacacatttacaagaaaagaacaaacaatcccattaaaaagtaggcaaatgacatgaacagacacttcttaaaagaagacattcatgtggccaacaaacatatgaaaaaaagctcaacatcactgattgttatagaaatgcaaatcaaaaccacaatgggataccatctcacgccagtctgaatggcagtttttaaaaagtcaagaaacaacagatgctggtgaagctgtggacaaataggaacacttttacactgttggagggaatgtaaattagttcatccattgtgtaagacagtatggcaattcctcaaggattctagaactagaaacatcatttgaccccctgttactgggtatatacccaaaggaatatcagcctttccattataaagatacatggcatgtgtatgttcattgcagcactattcacaatagcaaaaacatgaaatcaacccaaatgcccgtcatgacagactggataaagaaaatgtggtacatatacaccatggaatactatgcagccataaaaaggaaggtcatgtcctttgcaggggcacagttggaggtggaagccattatcctcagcaaactaatgcaggaacagaaaaccaaacactgcatgttctcacttataaatgggagctgaacaacgagaacacatggacacagggaggggaacaacacacactggggcctatcagggggctgggggagagacagcattagcataaatagctaatacatgtggggcttaatacctaggtgatgggttgataggtgcagcaaaacactatggcacacatttacctatgcaacaaacctgcatgtcctgtacatgtattccagaacttaaacttatttttttaaaaaaagaaattctcctcttcacccacccctctttctcctaccctttgcaaatctcatccttattttgaaaaagaaaaaaaagtttcagtggcaaatgctgaagcttgaggattatttattcataaagtacccacatggagtcactgagagctcctccaagctctcatctcaaacagaagaggctcattaagatgggaagtcctggggtctcaggtgtgattgctcagaaagccagcaccttcccctggttcagggtgtgccctgctgctcaggagcctgagagactctggtgatctggatggcagagggggttgccgtgagccaggagagcccagcattagacagtaaatggggctgtgacctctagaaggaagagcactggcctggaggctcaggtatggtatcagagtccagctcagcctccctctgctgtgtgtacctgggtgaccctccaccctctatgggcctcagattctacatttctacaatgatggggtgatctctaagggctcttccagctccaatttctaataacataatgtggcttcccaaaaagactgacaactgcttccagttgtcagtttcactttcagaaataaggtgaaaatgcaagactggagagagacagagacagacagacagacagacagacagacagacagacagacagagaattcattgttttgaacctgaggaaatcaagggactgtgttattatgaggaagcagctctgggctcaaactctgctgctcatttgctgagaaaaccaacaacttattcaacctctcttgagtctcagtttcctcatacataaatcatagattataataccgaattcttagttttcatgagaattacattagataataaaacttccatgaaggcatgggttctgccatgctcactgaagtctagtgccttaaacagagggtctggaacactgtgcaggcaacccaatttgtttcggacaaatgaatgaataaaaacacacgtgaaacactctgcaaagcactgagcccataacgaagatcaatacacttgcttgtattgttacagtaattgttactaacaatagcctgcttttcaccaatcctaaaagttactcaagccctgagaacagggattcttaacttggtgtcaagacttgttttccaatctgatgaagcctatgaagcctatggaccacaacttagagttatgtttttatgtggataaaatcaaatgaaaaggcattctaaaataaaccatttatcaaaatgtatttaaaaatcaattgtaacataatctacatgttcctttattgacatattaagtaaaaatatctagtagcagatataataataaccataaattcaaagcaataatgagccaaaaatatattttaagacatttacaacaaatgcaatatgatataaaactataagtaatttccactggtgacaaagtcacaggtactgctaacacacctatgtttgttgcctatgtttgtaatagaaagaaatgttaaatttcaatgagtggctggcaaaagtaaagatgtatgattttcccatgaaatttcatgaaactccagcatagaccccagattaagagctgctgccaacaatgacactttattggaaaaagcttttctctgtatagctgtcactgtgaatataatcagaagcttgggtcctgataggaagacaggaaattaaaactcaactatcatcacaccaaaataattctttcctgaaggggcatatgtgatgtggtgaattaacagacttgggcttcagaaaataaataaataaataagtaaataaacaaaagctttcaggggtttgcccttgcgcaaatgacctcccacctcagaacttcagtttcctcatctgtgaacaagttgtggtaatgtttcctccaagggtggctggagaatggggtaaaatacataagataatgtcccttgtgcaaatatgcaaatactggctcttctgtgtctcccttcctgttccttctagggcaaaagaagtttattgcagccatccatggctgccataggtgccatgatggggatgaatttctgaatttcttaaggacttactaggttctaactccatgctagatacttggcactcacaggtgctgagacatgacccccgccttcaagaagggcacaagctggggcagagatagcaagtaaaaatttacatggtgaagctgagtagacacatattatagacacataaagacgtcatgaggtcctcaaaatgaagcgatgacttttcctgggctggctagagaaggctttctagaagaggtagccacacatggatcttgaagaaagatgagaacatgaggaggagaaaaggaagaaaatagaaagacaggatggctgctagacgacagcacaaacagagtcacagaatgtggaagaggaggaggaggaaggtgtgttgcataaatacccatacccaatgagcccattattaaagtgtgggatgggtgggagaaaagggagctcaccaggcccagtcacgtgtgttttatagacattttctagttcacaaggtggatctcattacctcattttgcagataaagaaactgagtcatttaaaagtcctataatttcctagtggagccctagtaggaatgcaactgcctctgactctgaagtccatattcttctcccagaatgccacttgttgaatttgagttggaatcccagttttgctttgtatctcactgtgtgacctcttgaaggtcactagtctctctgacttcagcttccttatttgtcaaatggagactatagcacctacctctcaggactgatattaaaacaaaaatgataagccacttaaagcaccacatgcattgctgggcataaagcaaaaatccaaccagtgtaaattcccttttactgcacttctccatttgcacctggagtggccactgcctttgcatggttttgacaggctagtggaaagtgcaatttcccaaaagatcccagcttatgtaaaacacaaggcacctcaattgcctacaaagagttggtttccgtaatggaaatcataggcagcaacaggccgtgttcaatctgtcagctacttgcaaaaattttagtagtagacagtgagttatggaaattaaatagtagtaatttcatttgctggataagaactatttgatgtttcgaagcatcaagaatatttgtagcacaacttaatgaatggagtttttatgtggtgaaaatcacaaggtaattacccagtgatcatcaataattgtaaaattgttaagcactcagtgcctcaagtgatgattcctaatttcttttggaacaataaaagaattatccatctatccatccatccatccatccacccatccattcatcactccatttattattacaaatatatttattaagtacctgctctttctggccctgcactcttagctgtcagatacgagtaagccatagcttctgtacccaacaaggccaacagcagtcttgcaaagtagaaaagacatggcagaaagactattagagaggtctgtaggagctcagaaagggaagaggttacttccagtttgagttcaagagagtgagtgaaagttactgtatggatttcaaaagacttcagtctttttgtatctgaaattttgaaccatgtgattaagtatacttgttaaaacataaataaatatgttattgtttcaaagatcagtgatgacactgagaaagaaggaaaaggtgacaacagtggaggcagaaaaggaggaggaggagaggtagagggtcatggactgagaacagtcattatgtttgagctagtgtcatgagtacggaggcagaaaacaaaaaactgggagactgcaatcaaagtgaggtggtggaaatgaaaatcttgagtgtaaactattctccaaaagcttgccaatgtcttcatttgtatttatttgacaagaagatattggcagaccatagtggctcactcctatgatcccagcactctgggaggccaaggcaggaggattgcttaagcccaggagttcaaggctacagtgagctatgattgcgccactgcactgaagcctgggtgacagacagagaccttgactcttaaaaaaaaaaaaaagtattcattttcatcaatcaagttggcaaatattcttgccaaatgataattctcagtgccgaagggggtgtagtgaaatgctattttcgtattccactgtgggagtataacttgccaacatttatggaaagcaatctggcaaaatgtatcaaaactcgaagtgttcgtacacgttgaccaagtgatcacagtaatcagttctagaggaaaaatgagcaatgcagatgatgacatatgcacaatgatgttcgtcacagcattgtttataatggggcaaaatgaaaatgttctacatatctaacagtgaggaaatgatcatcaacatatggttcattcccacagtaggatgtcctgtgaaagtttaaaatcatgatttctatgtataactgatgatatggaaaaagtttgttataatattaatttttaaaaggcaagaaaaattatatcgatataaacacatgaatgcacatgcccatataatccaaaaacagatattttaaggaagaggtagcatttaactgggttggatgtgtggagacagcagtgagactacatggtggacagcccttatatttgtttatataatatccatgtccctttcttctgataacagcacctccattttgggtttgcggaaattcacatccctctttcctcacacacacacactggatacattcttgtagatttttgagttaaggtgtcttgttttcctctgacttactgctgagcaggtgaactgacaattaagccaaataggtatttactcttgggaatctgaaactaccccctcggccttcctaagtggcatggaggttgcagatgcagaaatcaattgttcataaactatccacgctcttctaactcttgaaagttcttccaggtagcccatgaaggtaggcctacttggatttgcagactgatgcaggccaggcacaggagatttctagacagagcaatggcataaatagaactaccatctacaagccattatgcaacactttcattcagagcttctggatttgggacagcatgtcctgagttttgtcagtagaacagacaaagcttcaggcttttgagaacagtgttgagtgaagatgctgagtttcatgtagccagaccagaagggatgctagtcttgtggcatctgaaggagacagtagaagacaaaaggcagcagaagaggggcttccaccttgccttgtctccacccaggagagcatgaggcaagtagaaggtaaagatgaagatcaagcggagtgtgcctagagttcatcgttaatagagatgcttggtgaattccatcccacagccagacaggcaggcttctagacagtctagaagcccatgtctcttccagatctaaacttggggacttatgctgcctagcaggccatggaacacaggagaaagccatgggacctggattccaagagaaggggattcaagtccttctctgctgctagtgtgagaggacttggatagtcacttcctgtgatagtttgttagggctgccttagcagaataccataggctgggtggaggctagaagtccaaaattaagacatcagtagagttggctgtaatctgaggtctcactccttggcctgtagatttttcttttccctttgtcttcacatggtctttcctctgtgcctatgtgttaatctcttcttttaggaataccagcccatggtattcctctttgaataccagaggaatctcttgattcctctggggaatctcttgaaccccagacgcagaggttgcagtgggccaagatcgtgccactgcactccagcctgggtgacagagcaaaactccatctcaaacaaaacctcctcttctggtagtttgctagccatctttggcgtttttggcttgtagacacatcactctgatctctgccttgatgtctgtatgacattctccctgtgtgcatgtcaatctccaaatatccgccccccccccacccacttttttttttttttgagacggagtcgcactctttcacccaggccagactgcagtggcgctatcttggctcactgcaagctccgcctcctgggttcatgccattctcctgcctcagcctcctgagtagctgggattacaggcgcccgccactgtgcccggctaattttttgtatttttagtagagacagggtttcacaaatttcccctttttataaggacaacagtcatatgggattagagaccaccacatttaaccttaattgcctctttaatgaccttatttccaccagaggctggaaagggtgtgtgtatggtcatgggtgaagagaggttagttaatgggtataaatatatagaaggaataaagtctcatgttcaattagctagaagagaagactggaaatgtcccaacacatacaaatgaaaattactcaaggtgatggatataataaataccctgacttgatcattccacatcctttacatgtaacaaaatattaaaggtaccccatgaataagtataaatactatgtatcaataaaaaaagaccttatctcaacggagcacggagcacagtggctcatgcctataatcccagcactttgggaagctgaggtgggtggatcacctgaggtcaagagttggaggccagcctggccaacatggcaaaacctcgtctctactaaaaatacaaaaattagccaggcgaggtggcatgcacctgtaatcccagctacttgggaggctgaggcaggggaatctcttgaaccccagacgcagaggttgcagtgggccaagatcatgccactgcactccagcctgggtgacagagcaaaactccatctcaaacaaaacaaaacaaaacaaacaaacaaaaaaaaacctcttatctctaaatagtcactttctgaggtactaggggttaggacttaacacacaaattgtgaggtgacacagttcagcccatattacttctcttttcagagcctcaatttctgtatgttcaataaggctgtttgctcattcatttcaaagcatgtccatccattcatttactcactcattcattcattcaatcatttagcaaatacctattgaatgccaggtgttatcaccaggtttaggtttatgcaggaaaatatgaaaaaaatagtcttttctttatgtcaaaggggcaggtgggctttctgtgctactatttagagaaggttggggagaagacctcaggactgatcctcttgcctctacttcttaagagtctgtgaggacctacaacatcaggcagcaaaaaagcctagtgctggccatagacccactgtcagacagatctacagtcccaggaaacatgctattatctgtccacaggtctggtttgctctgtcagtttcattttagacaaggccactaattggcctgcctgccttgccagtgggaaaagaaatagtgtggggaaggaattggtagagacagtgctggtctgttaagtacctcaaaggcagactgcccaagcaatgtgggaagactgattcctcctgcaattgtttcttttttctttctttcttttctttttcttgaaacagggtcttgctccgttgcccaggtttcactgcagtggtgcgatcacacactgaaggctctatttcttagtttcaagcaatcctcctacctcggcctctggaatagctgggactacaggcatgtgccactacacctggctaatgttgttgttgttgagatgggttttactatgttgtccaggctggtcttgaagtcctggcttcaagtgatcctcccactcagccttccctaagtgctgagattacaggtgtgacctactatgcccgacttgctttttgttgttgttttgttttgttttttagtggggatagaacttggcatttcagaaataaaagaatattttttttattgagcatctattacatgataggtactgctctaggtgcagcaaaggcagcagagtattaaagagagtcctttccctctcatgcaggggagacagataacaaaccaatgaacaaggattaaagacttatgtggtttaagagttaaatattaacatgatgggagcttgggggagctgtggtggggcatgctgatttagtaaggaggtcagggatggccttcttgataagatcatcatggtgtaggctcatggacataatcaaatgggaatacgaatgcagtgattagcacagtgtctgatgtgaaacaagtgctcaataaatttctgctgtcgatgttattgtgaataatgtgctaagttccttatttgaatatagggacattatgcctatttcataaggttgttggatagattaaatttggaaaagcatataaataaacttacatggcaaattcaacaatggctgagtactagctaggtgagacagccaggggagacagacataaacacacatagaaatacatgcaagcacatcgtataaagtcagagcagggtaagtgaaagaaaagaagtcagggactcagggactgagatggagatgcctggggagaagggacaagctgtttaggatgggaggggtgcaggatcccccgaggagaggcttttggacagagggagaaagggaattctggaaacaaccagcctaggaaaaaaacgtgttacaagcagagagagcagcaggtgcaaaggcccaggggcagggatgggggtggcccttcaagaaccagcaggggccaggtcacagatagtctcagaggtgacagtaagaattttgagttttactataggccaagagatacacaatgcacaagtgttaaggagttttgagcaaagactgcaatgatgtaatttactttgtattgttgttgtttcgatttttttgagacagggtctcactctgccacccagggtggagtgcaatggcatgatcttggctcactgcagcttctatctcctgggctcaggtgatcctcccacctcagcctcccaagaagctgggactacaggcccgtaccaccacatccagctaagttttatattttttttagagatgaggtttcaccatgttgcccaggctggtctcgaactcctgagctcaagggatccacctacctcggtttctcaaaatgctgggataacaggcgtgagccactgtgcccagccccaatgtgatttacatcttaaaggataaatctgatcgattcattcaggtaaaatttcgtattgataatatatatttttcatatatcataagatcagcagtaacttatataaagtgtctgaccctcaatctaaaataaatgtattcattagacctggcatggtgggtggctcatggctacaatctcaacagattgggaggctgaggtgggaggatcgcttgatcctgggagggtcaaggctgcagtgacccattgctcataccactgcactccagcctgagtgacacaatgagaccttgtctcaagaaaaaaaaccaaaaatcaaatgtattcattcatgactactttgtgtaggcatgccagatacagcagtgtacatacaggcagtgacaacatattgttttctggtggatcttctgatggttttattgaaacagtgtagatgctcaataaatattctcatttgatatgaaactatatattatgatattattcatatttttatcactcttgctctaaaagtgatagtaagccttctccagaggttctttcttttgtttgtttgtttgtttttgagacagagtcttgctctgtcacccaggctggaatgcagtggtgcaatctcggctcactgcaacctccacctcccaggttcaagcaagtctcatgcctcagccttctgagtagctagaattacaggcacgcgccaccacacccagctaatttttgtaattaaaaaaaaaaataagttctggaatacatgtgcaggacatgtaggtttgttacataggtaaatgtgtgtcatggtggtttgctgcacctatcaacccatcacctaggtattaagccccgattgtattagctatttatcctgatgctctccctccccacaatcccccctcaaggtcccagtgttgttcctctccctgtgtccatgtgttctcattgttcagctcccacttatatgtgagaatatgaggtgtttggttttctgttcctgtgttagtttgctaaggataatggcttccagctccatccacgtccctgaaaaggatttagtctcattcctttaaaacacccttaatttttgtatttttagtagagacagggttttgccattttggccaggctggtcttgaactcctggcctcaactgatccaccagacttggcctcccaaagtgctgggattacagatgtgagccattctgcttgggctggaggctcattcttgaggaagagaaggaagcaaaagaaaaaaaagaagaggaaaaaagaaggcaagagggagcagggaactgccatgtctcaccactatctctctggatatgtggatgtggccttcctctcatatgcctatttggtggacttttattcatgtctcagggcccagctgaattatcacctcctccatgaagttagaagccctcccttcaacacaggcacagcagtgaaattgctgccgctggcctgttcacctccctggcttccgggtccatctctaatgaggccaatcccactgcataggagtatgctgtgtgtttgctcaccaggttgatgattctcattttttttttgtgcatcctcaggaattagaactggttttcatgtgtgcctggtataataaatgtttagcgcctggtgcagtggtggctcatgcctgtaatcctagcactttgtgaggccgaggcagaaggatcacttgagccaaggagtttaagaccagcctgggcaacatagcaagaccttgtctctacacacacacacacacacacacacacacacacacacacacacacacacacaaataagaaaattagccagatgtggtggcacatgcctgtagtcccagatacttggaaggctggggtaggaggatcacttgagcttaggacttggcagctgcagtgagctataatcttgccactgctctccagcctaggcaacaaagcaagactgtctcaaaaaaatgaaaaataagaaagtttaggaaagaaaggaagaaagaaagagaggagggaggaaaaggaaactaattctctcctccttatttttccagataatgctaaagctcatttcaaccagcaagtgctgagtttattgatcaacatttcagaggtattgaactgagtttgtattgacagaaataactggcaaccaggcagggggagcgagaaatgtgctgacagtcagcaaatcatacgcctggtattggagagcctgtctatgccaaaggggacaatcattaatttcctattccttcatagttacattccttgggttgactgacaagttcattttggggattcatctggccatttataaataaactcctttcttattccatattcctaactgcacctgccacgcagatgatcggctgcctggcactcacataaaaatttcaaattgctagcaatagctcaacatggtagttaaaggaaatcttctggttattttatgatataatcaagagaacccatttccccaccattgtagatatctcaggtccatgcacaaaacccaagtgaatttcattctttgccccctaaccacgtttaaataaatgacatccaagtacatagctgtaaaatgatcttttgacacttaagctttcgaaagtcccctgtcaaagctgtgtgactctgagtaagtcactgaatctctctgagcttgttttcttgtttgaaagatgaaaatgtattcatggcactgctgataaggtcgacaaggtaacagaagttagcatgtttaaagctccccagggtggaaagaagcttctaatattatctcattcagctccaagaagagaagtgaccttttccaggctggtaagtggcaggggggtggagcgggggtatatgaactcagcaccgcctgaggcagctgctcacagaaagaaaatgtatcattgatcttattggtgattttactcctatgcttggtctgaaattccatttggtctcagcggcctcaaggttagcataggaagaattaagctctctgttaggcttcacatcaacaaggcaattctagttcatctagaagtaattccagggcctccaggagtcatcaaagcaaaagttcttagagcccaaatgcctggtgctgatgtatctaatgtattcattgttcagtgtattttgctagcagtagccagatgtaccttgatatttgcattagtatacaatttctcttaaagactgtttatattttaaaaggttttgagtagtgctaactattaacttgggcaggaaaaattctctgctgaaagaaaatcgggcatatgtggtggagctttcaggctaaagcagaagatatttcgcttttgtttactcaacagatattttctgaatacctgcctgggtttgtgtttggtggtattctgtcactgttgctctttttcagctttcattagagtgaggaagatgaacactaattggatcatatgtttatcaagtgtttactatgtgtcaagcagtgagctaggcacttagcatatgctagttatcttagcccaactgtgtaaagcagcaactacgttacccccactttatagatgaggaaatgggggcctaaagaagcacatgggtgtgcacaaagtcccatcgctgggagtatagggtcagaatacagatgcaggcaggctctatgacaatgggctttgatgagtcagagtcacttgatgaacttaacatttggcctctagtccacgaagtgagttgatttctgctgagtgatgggcacttggtcatccattttactatctttccactttcttttatgtttgacatgttccatgataaaaattacatatatgtttttaaagtacagtctctggagctagactgcaaaataggaataacaataccatcatccttatgggattgttgtgaggatgaaatgaattgatacaaacaaagcatttagagctgattgcattggaaatattcaaggtatataagctattacctactataactgctaagatggaaaaccctgtagtgtttagcatatatagcaagtcccctgcatgaggtcctgaatatgacagactactgcacattttcctaaaattttaagttatctgatatgcctgaatacataaactttgcttagaaatataagtgaaccagtctcatatctaattatagtatttcatttactactttagtaatagtgatatctatataatatttaaaatcacttatttataataaataaatttagaaatactgttcttgctcactcttttgtttcagtaaaactactttattgcaattcttcacatataattcttgattcagtctaacgtctctttctcaagcagttgctatttaaaataaattagttgagaaagtaaccttcatgtgtgagaaagtcatgcccaaattgacagagtcttagcttaggaacggttttaaggtgtagatgccagtcttatataccagcatttacagtactgtggtttgagggctgatgaattgttgacctggctggtgagagtgggtggggtggctgggagctggttgctggaagctctgagaatgaagaggtgagagcaaaagagagaaggcagatgaagccaagctggtcccggtcagattgcactgacttttaatctattttttttttcattataaaagtaatacattgctgctggaaggcatttggacaacatcgaaaagtaaaaagaaaaacaaatccattaatcccactgcagagagggcactgtaatcgttattttgctgtctttgatccaagcatgaatgctctttctctagataacctcatggctcaaatgtcacctgctcagtgtcatgggatgactgcctaatatgaggactgtcatatttagcaaataaaaataaaggcacccaattaaatttggattttaaacagcaaatttcttttggtatacacacttcccaaatagtgcaattattaattgcctgcctgaaattcaaattcaactgggtactcaatattttatctggcaattctatcccatggccgatggcacttacaccccttctccattctccggtactcccaaactcccaacacctaaaataatttatcacacttattatttattttctgattcttcccattagaatgtaaattacacaagagcatgagtttttatctgttttactcattgaagtgttgccaaaatctactaaaggtgtatcacacacacacacacacacacacacacacacacactttagaatcttactatacatataccttcatattcttctttttccttaatcttactccaaggacatttcaggacacttttttgtttctttcaaacacattattttcatggctattttgaagttgcccaattaaatgatccaatcccctattagagaacatttggttgttggaagtttttctccattataattagtgccctgatgggaagctcagcaggactgcaggtgcctaagattctgcccactctaaagcaggagagatctaggagtaattctggctataccctcttactagctaggtgactttgcacaggtcactgactcttccagcctcagtcccccagttgtaaaccgagatgctagtagaacctggctctacttggtattgtttgaactcaatacgatgatgtgtcagggttcctggtaggtgcctgcatggagtgagcactcaccaagacatgcagttattattagtatcattccctacctcaacacctctccctccctctctcctctcttccctcctcaccttagtaattatttccctttatgcaacaggccaaatctatccatttccaagccaccatacttcctgcttcttaggtccataattgctttctctatcccaagcccactgccaggttaactcctgctgatttagggataccaagagagatcagcctttgaagcttttctgaacactcaacgtctgcccccaggcccacgcttggtcagaaccctgcttgagcatccacatttttcccattagcacactgactacctcgccacacaatggcctgggtgtttgcttttcacttcatttgagtgagcatctgcagaaaagcaatgactagccttccctacttccattctaggactgactgagagccttcttagtgtcctgccctgcacaagcacaggttagagggagaatccactaccaaaaaaatcccagacatttacttgccagttcctagatcaaaaacatgtgggcctcctttctgcccctgaacccagagtttagttgggcattattcttgttcttcaaaggaagtggtaggtagggacagggtggatggtaattgatatttcatggtgactgaaagacttgtaagtacctatttaaaaaaaagtcaatgactccattacaatttaaaagaaaaggagaaaaatagccaaatgacagttatcacataaagataggagccagtaccccactatgagtttgaccagcatgatttgtaattctgagaaaatcctgatgatagataaaatattaccattgttctaattttatttgtttatttagttattgagacagggtctcactctatcacccaggctggagtacagttgcataaacatggctcactgcaactttgacctcccaggctcaagcgatcctcctgcctcaacctcccaagttgctgggactacgggtgggtgccaccatgcctgggctggcctcctgggatcctgggctcaagtgattcttctgccttggcctcctaaagtgctatgattacagacgagagccaccgatgcccagcctattctcatgttgtaggtcagtaaagaagttcagagagggtaggttatttgcgcaatgtctcatttaatcaggggaggagatgggattagaattcaaggtcttcctgacacccaaacctctgcaaacagtatgaatttaaggctccacaatagatactatgatgtagaagcaactgattttccaaaaggttcttgggttatttatttattgcaaaggcattttacctccctgcacatttatgtaagtggtcccatgagttggtagaattctctgaaaaccaatacattctgaaagcaagcttaatacatttatttgtacagattgagcatccctaatccaataatctgaaatttgaaatgctccaaaattggaaactttttgagtgcgacatgacacctcaggtggaaaattccataccttttctttctgccggttcaatgtacacacactttatttaatgcacaggattgttaaaactattgtatacaattcccttcaggctatatgcataaggtgtatatgaaacatatgaatttcatgtttagacttgggtcccatctccaggatatttctttatgtctatgcaaatattccaaaatctgaaaaagtcagaaatctgaaacacttctctagtcccaagcatttcagataaggggatactcaacttgtacttagtaagcaccaggggtcaagtctttgctaggagaccaaagggatgctctgtatctattcataagagggtggaagtggaagcggtcatggttttggcacaggggcaaaggatgtgagttagaactggatcctggaaggctttctgaaaggagtttggtagtagtatcctatcaaggtcttagtaatctgggcatagtttctgcagaatcaaattctcctatattcaacaggacagcaaatgaagactgtattgattttctgcttagatcaataaataagataaattgaccagaagggctaaatactgatcagggtgaactgaacatcaacatttactaagagcagagggaggagaaacataaatatcagaaaaatggagatgccaatagagcactggggcagtggctcagtttccagttaaaatgtgtgtgtaaggattattattttagtcatgtctttacataaaaaaagggagtggaattaggttattacaataaaacttcatttagtcagactgtgagaagaccaattgatttttaaaaaacaataaatgccattgaatttaaatgcatggatatgatatggcaagacaaacaaataaacaaatagtcagaagacctgagtcattaagtgtccttgttaagtgcagaaaatcacatattattcataagtgtattctatttgccaagcacagaacctggaatatagatgaaatcttggattgagttctatgagagctgacccagagctaaggaatgtggtaatagtagttgatttgggaggtgattccaggaagcaagtgagggactgagaattgagccaaggaatggaggaaagcaaacaagggtgtatgtattagttcattttcatactactataaagaaatacctgaggctaggtaatttattttttaaatttttattttgatttttttatgagatggagtttccctcttgttgcccaggctggagtgcaatggcattatcttggcctactccgcctcccaggttcaagcaatcctcctgcctcagcctccagagtagctgggattacaggtgcctggctaattttatgtgtttttagtagagacagggtttcaccatgttggccaggatggtctcaaactcttgacctcaggtgatccgcctgcctcagcctcccaaagtgctgggattacaggcatgagctgccgtgcccctcctagactgggtaatttattaaaaaagaggtttaattgactcacagttccacatggctggggaggtcttgggaaacttacaatcatggcagaaggggaagcagggacgtctcacatggtggcaggtaagagaagagggcagggaaaactgccatttataagaccattagatctcatgagaactcactcatttaccatcatgagaacagcatggggacaccatcccagtgatccaatcaccttcctcccttgacacatgtggattacaattcgagatgagatttgcgtggggacacagagccaaaccatatcagtgtgttaatgagggggctaccaggtgggcaacaagaactcgatctcgttatggtctctctgagagactgggtaagatacaaccctgaatctttctgtgaaggggcaagaaatgtggcatatttttctaccaacctcctgttcatcttttgctgtggattgtgcctaaggccatcatcactgcccacctgctcccaaaaaaataacctcaggcagacagatttaggtgcagcgcactgaaggtgcaggtgacagctgtcaaggaccaaatgtagatgggaaggacacatggcaagtggtaataccaggcgaaggactgcaagatcaagctctgtgctctgtgacgattgtcaagtcaatctcctctctgggcaatcagggtctaactctaaaaagcgaggcttgaatcttcacattccctcccagactgagtgccagtaattctgaaaaccagatggtcaaactcacaatcaaggattacaggccatttaggaaactgcttctcacacagataaaaatgatacatgatgagcattccacttgttagcgtttaactgtgagcttttcaagtgcttgaacatacacacaaagatgtacatgcactaagtgatcactgaggcattgtttgtagtagcaaaaaactgaaaacaacctaaatactcttcagttaggacatcgctgaataaaactggcatattcatatgccggaatgttctcctgcacttaaaaggaacgaactgaatctatatgtgtcaccatgaacagagttcaaaaaatattgctgagagtaaaaaaaaaaatcaagatgcagaatgttatatatagtctgacaccatttaaaaaaaacaagcacacattacagcattcctatgggtaggttacatatctggaaaagtatttttaaaggactgaagtgacaacacaaactcatttaaagttattttggaaataacttttccaaaaatcacatttatatgagtggctacttttgggcagggagagctgggacaaagactagattagcaatgacaaatgtggatggggtagtcagagtgattttagttatagtgatattgttctaatttatgaaagcagaattgattcatgcatttttaagtgaacttaaaaaaagagagaaatgtctagtacgtagcctagtatcacaggagactacacgataatgtggaaggagtttgaagctggatgcattggctcgtgtctgtaatcccagcactttgggaggccaaggtggaaggatcgcttgagtgcagaagtttgagaccaccctgggcaacatagtgagaccctatctctacaaaaaatagaaaaaatagcgccaagcatggtggtgtatgcttgtggtctcagctactcgggtggctaagatgggaggatcactttagccttggaggtcaacagctgcagtgagctatgatcacaccactgcactccagcctgggtgacagaacaagaccctgtctcaaaaaaaaaaaaaagagtttggaaaatagagtcagaaagacctggtgaacctacttcgcaaataacttctctgctaagagccttcacttcttcagttccaagattgacaaaacagaccaacttcatgaagccgagtgaccacagggcaacctgtagtgtcttctgtctggatcataaatttgcattcatctcctgtttattccctgctctcttatctgtgttttttcatattttaaaaaagtgttaaaaattattccttttatgttttttatttttttgagacagggtctcgctatgttgtacaggttggagtgcagtggcacgttcacatctcactgcagcgttgatctccctggctcaagcaatcctcccatttaagccacccaagtagtgagactaaaggcatgtgccaccacacttgcctaatttttttaaatatattttgtagagatgggtctcactatatcgccctagctggtctcaaactcttgggctcaagtgatcctctttcttgccttgacctcctaaaatgctgggatttcaggcatgagctaccatatgcagtgttatttctttattgagttgaaagttgaggttcctgcctaacccccatggaatcaggtatttgattaaatagactcagtattaacaaggttttgatgttttcttaattcctatagtgccagttgatattggaactgagcaaccattcagctacacatgaatataccattttacctggctttgtgggtatcagtgattatcaatgaggaggcattccacaatgacaacactagggggtcttatcaaagtcaaagggacataccatacacctgagttagaactgctggagttaaatccaatcaggagaagctgttagggcagactggccttttccataatggtgtccaaaggtgttcaggcctcttgcttttacatgggctgtttcctcacctggaactctgttctctctcccaacattcccatgcccacatcctattttcctttaggttattttctccatgttgccttcatgaataaatttcctccccacaaaataataatgatcatgaaccatcctttgcaaaattataacagtgagaaaaacccaacataggagaaatatgacagtggaagatatctgacataaccaactccatcttgcttctaacctccaagctatccttgtttattcctggtggaggctatggtaacctcaggaggaattcagtttacagtttaactttgaaacaaagataataacagctccttcctgaaacaaaacccatccttgcttggagaccacactgcctttgtaaaacaaacaaattagccacaggattaaaagttatggctcaggagtcatgcagccagagatcacaggattcctaacctccccaactgctcctgcatataacactactgttgtaaaacctaagattggtatttgaggtattttttcacatcctgcattccgatatccaagcagacccgtaaaagtggctcatctggtattgtggcccccacctaggaactgactcagcacaagaagacaagatttaactccctattcatttcatccccaacccaacaaatctgcattccccattccctaggcccctgctcgtcaaactatctttaaaaaaccttagcctccaaattttcagtgaggctgatttgagtaataaactcctctcctatcacttaactgaatctgcatttattaaactatttctctattgcaatgctgctgtttcagtaaattgactctgtctgtgcagagggcaagaaaaacctgttgggcaatgacaatcatgatgatgatagttaccatttgtagacaccatgctggatcctcatctaatcctcatagcaaccctgacaactaagcctccatattcccattttatgaaagaagacatcaagattcagagagtgtggaaggacatgacagagaagggtttgtcatttttttcaggggtgatgctttttgatcttctcccccctcaccacatttatggctgcctggagtctatggtttctgtgatatgtaatttgtagagagagaaatcattttgaggattttttcttattgagagctatattcctaggcttaaccctcagaaatgaaaagtttaaaagttaaagtacaagtcagagagaaaaaatagagccctctgaaatgatctaaagtaagaagtcagaccgattcttcaaggcagcacacacagaatggaggcaaggcaggaagcctaccattggttccagctcatcctgcaggaaggatgaagaggaactaagccatcacctcacctgcttcctccctcccttctccatctccctctttcctgcccccctctttcttctccctccaccttcgtttggttctcaggctccacaggaaataagtgggaggggacagcacatttactttgtaaagcaataaggagactgcttctctacgggctttattttatttttgccataagcttctcccggcttgccagcgggtaaaacgttttaccatatccaagaatttctttctttctttttttaaactggacttcctaaaaatgaagaaagaaatgtgaaaaatttgttcaaagttaaacatagaatgagtggctgtggttgcaattttacctaaattccgactccaaatcctatttccggctactgattgtgtgtgtgtgtgtgtgtgtgcgcgtgtgcaagtgtgtgaaagctgcattattcatatggccatttttactttaactcaccttatatgcccatatgcccaggcaataacgcattgcatatatgacagtggtcctttaaaattattttggaaggctgggtgcagtggcttacacccataaggaggctgaggtgggaggatcctttgagcccaggagtttgagaccagcctgggtaacatagtaaaaccttattgctacagaaaaaaaataatttataattagccagacatagtggcatatggctgtagtcccaggtactcaggcagctgaggtagagggttgcctgagtttaagaggttgaggcagcagtgagctgagatcataatggagctgaaaaattcctgttgcttaatgacattgcgacagtctgcataacattgtaacaatgcattaatcacctgtttgtggtcatgctggtataaacaaacttactgaactgccagttatataagagtatagcacatacaattaatgtgcagtatataatagttgataataataatacatgactatgttactggtttatgtatttattatagtatactattgattgttattttagagtatattcctacttatatcttttaaaagttaactgttataggccaggcacggtggctcacgcctgtaatcccagcactttgggaggccaagatcacccgaggtcaggagttccaggccagcctggccaacatggtgaaaccctgtctctattgaaaatacaaaaattagccaggcatggtggtatgtgcctataatcccagctactcaggaggctgaggcagaattacttgaacccgggaggcagaggttgcagtgagccaagatcatgccactgcactcaagcctgggcagcagagtgagactcttgtttcaaataaataaataaataaataaacaaacataatataaaatgaaataaaataaaataaaagttaactgttataaagcctcaggcatgtccttcaggaggtatttcagaagaaggcactgttaccataggagatgacagctccatatgtgttactgccccagaagactttccagtgggaaaagatatggaggtggaagacagtgatattaatgatcctgaccctgtggaaacctaggctaatacgtgcatttgtgccttagtttttaacaagaaaagtttaaaaaataaaaatagaaaaaaggtttatagaataaacatataaagaaagaaaatatttttgtacagctgtacaatgtgtttgtgtttcaagatgtgttacataaaagtgtaaagtttgaaaaatgaaaattttataaagtaaaaaatataccatattttggtgtacattttctatgcttagatacacaaataccattgtgttacaattgcctacagtattcagtacagcaatttgctgtataggtttatagcccaggaggctgtgtcacataactaggtgtgcactaggctatactatctgggtttgtgtagtataatctaggatgttgtcacaatgacagaatcgcctaatggtacatttctcagaagatatccctgttgttaatcgatgcatgactgtatatccttttggttctgctttttctagagaaccctgattaatataagtctatcctcaacaaagctgccagaggattccttttgaaacttagggtagatactgttccttatctgtttaaagccttccactggcttccaggagtaaatgtttttttacttctttactttacaactttttacttctttaaaagtaaaagttaaggctattcccatgtctttgaagagcccagtaggatctgaccatccattaccactttgaccacatctcccattacttcccccaactctgtctcttgaaacaccagggattttctgcctcagggcctttgcacttgctgttgttctctttggaatgatattttccagacatccatatgctgcattcctcctcctcttcacttcctcctcctcctttttatttgcccaaatactgtattcttgggagagcttccctgattcttctacttaaaattgtggctctcaccccaccatcatcactcttaagcccctgctgtaattttaccctgctgtacttttatggcacttattacctcgaatctactgtataatttacctgtttatcatgctattttttgtcttctccccctagaatgtaaaatcgttgttggcagagatctttgttttatatactgatgtttacttagcattagtatctagtacatagtggatatttgcgaccaattggattttccaaagctggccacaacagtatctcccatctcacacgtacctcttgcaatgtgaccttgagtgttagggtctcttaagaaatggaaatgacccaggactttctgctgtagaaaacagacatagataccactcaacaggtgaattaataataactgacacttctatagcaaaacttggacatatcctggcctgggtgctgaacccacctcctcctcttctggatatgagacatactctctctctgggccttaggttccttgttgagatggactaaatgagatgatatagggaaagagctcagcccagggtgtggcatgtgagagtcatgaggctgtattaatagtttgacatttgtttttttccatgcagaggcctgaggcccaaaggaaagaggtccaaaaaggcctgtttacctctacatcaggctgatgccctggggatgtgcttcacaggggactggcatagcagatgggcaagaaggggccagctctcacttgccttctagtctctgccaggaacacacccctccctcagcttttgggctttccaatgcctgatcaatgttcatgtctcagatcattagttgcatttgaaagcctcccctagtctcccagggttgagagtttctgctgtgcgccacagggtccccatccttctaccatccttgccagaatcatgtcagaatgtgagtgttgtatgtccctctcattcaactgcacatgggtgaggacaggagtagagactcccttgcttctggtacagctctaaggcctaccacagggcctggcatacatacggtagaaattgagcagctctgggaagtgtgtctctccaggacacaggagcatcaggggttaaggctgcagaaggctcctatgtcctcgtggcagacagtctcaaagggctgcctgatggggtaggacacagacagtctgaggaataaccatgaggtggcaggtgggaccgcagaatgacactcacagtctggtcaggctgttcatatttaagaggctgtactgtgttgtggttcaagtcctgtcctgggagccagactgcctgctctccaatcccagctatgttgcttactacctatgggacctcagacaatttacttcagccctgtgggcttcagtttcttcatctgtaaaagaggaataatgaggttacccatcttagaaggttggaatcacaaagatcaaatgagttcattaatacatgtaaaccactaagaatggcacttggcatagttggagtgctatagaagtgtcagttattattaatccacctgttgaatggtatctatgtctgttttctgcagcagaaagacctaggccatttccatttcttaagaaattcacgacaaacaggattacaaaaataaactcaagattaaggctgcgtgatgaacatctctcaatctttctggagtgtacagtggctgtgcactctagaaattcatttggtggtaacgttacagctctatgtttgcagccatttgtgactatgaggcccaggccaaatgcccttccaccctccgcacccccaactctcctccaagtcctccaaaggcccctctgtggtcctattttttggcagagaatgaggagcaggcctggccttctgaaaccctctccactcccagccttgggagcctcttgtctccccctccttccttagagtcttggctatttgaggaaactgaaaagactgcccagggagctaatcttgggcttcacttctggaggggccgcgggtgggtggggaggcagattttcctgtacagaagagcgtgtgctccttttgaaatgtcctagcggaaataaatgtacaacctattgtatgctgccaggagccaccagcaggagttggtgtgatacaaaagcggcatttgtaatggcacaaaacacttagcactttaccaagacatgcacaggatataaaaggagacgaagggcctgacgaatccgccaagaaagcagcgtgtcctgaatgcaggagagccaaccactacaccccaacacacagtctttatcctcttaaccatgctaccctttcgttagtatagaagggagtatttggacacaggcaggaaagaccaggtcggtctccttcatgtgccttacactcagtcacttgcctttgtcttcctaagcagatgggcccgcccctcacattcacagtgcccagggcaagagaacaaattgcctagtacaataagactaaataatggaaagctatatattaaagtaacaagacactaaatgtgttttatgctcttacaatgacaaatataccttcataacaacctggaaggtgaggctcaaatttagatttactgaatttccttggaagagtgggtggcttaagggtagacctccaatattcacggtgctcagggcacccagatacacagggaagcacagcagtaagtgatccctgttttttttttttttgggggggggtgcggggggtgtgccgtttaagagcctaggagtcagacatcctcattcagagatgtggaaaatgctttctctgtctctctaaagctttgtttccccattttcccctttgcacttgtgcccttcacagccttggagaagcagcaggttcctgttctccactgaccctccagaccttagatttctgccaaagccagaggagagacctcctgtgcctcacgctcagtgcttggggctcgagatgaccagggaaggttgcaaggaccctgcccccaaagaattcacaggctcttgggaagacaagaagcccaaattcacctgagctactaaataacataagtgataaggatcaaaaagagtggatggtgtgcaagatagtcacacttgaggaccaaatcctgggaaagtggcccagaaaggaaccagaggaacctttttgttcaatgttagggaaaaacaaaaggcagaacctttcaaaggaaacatgactttatgtggaatctggacataggaaactgaagaaagcaaagctgtgcttttcgggagaagcaggatgggagtggggaactgagattccagcccccccagacacttttgtctttcccccttccatggacagaagacccttctctcattccactcttcccaacgcccatggaatgccaggtgtctgggcagccctatgttaaatactgttggtctagtctaatcttttaaagtaaaagaagaatggttttcttatgtgcccctcaccacctatagactgtcagcttctaggagacagcttctggaccttgtttttgttttttggtttgtttgtttttgtacctcagagtctggtatttggtgactactcagggagtgtgagttgagatgggttgaaggggaaatgtcagcccagaatcagaatatggagggaaagacttgaggtaattcaaccagcaaaataccgcaattacttttgtgccaacctaataccttgaagttagagttttatattattatcaataaatatcatgaaatctatagccccttaaaatgtctctattaatatttttctagctcatttccctgtgtagtatttgtccattaattatcttacagtaacaattgctaacctttattgagcaactataatgtaatctttactacgagcattgcattcattttctcatctgactctcagaacaaccccttcagctaggactatgattccctttatgtagatgatacactaggattcaaagggcttaagagaattgtacgagatcactcagctacaaagtgtgaaacgtggagtaggacccacagtgtgtgtttactgattgtttaagaagagtaggttgtagagtcagtaatgtgggggacccgttcccttttccctggcctgcagcagcagagctgggtagtgaatttctctcactgcagcttagaagcctgtgtctcaggctttcctcagaagccaagacacctcagttttcagtactggccctgaggcacatcagagagtatgagacaacccctcagggaagtgtccgaggcaggctccaagaagtgacagcttgctcaaatcccagatccaggaaaagcttctgacctctgtttcggagtgtgctgcacctttgtctggaaaggcagacctgccttcatgggctctcccattggtgttaagcaaggctaaatgggggctatatttcactctagaagtggctgcatttcaggagcagagtgtgattaagaaagatggatggcgggtaatatccgttaccaacacctgtaccgtgctcagggatctatttggcagaaaggggctatgtaagagcaagatcattaccatttgagctagaaaacaaaatgtggtggaggtggtgaaggatgggcggaaatgggagggaatggaggatgacagaaggcgggaggtaaggtgctgcaggaaaatcctatgctgcaggacgtgggtccgaagcctcctgggcctcaaattccccctagtaagatgctgacagccttagaggttctgtcttgctcattactgaaggctgtaggaggcatcgtttggaggcaaccacacccaacagtaagactaggtcagctctcaagaatagccagaactgagttattagctaaatgcggatagcctcacccctcacattttgagaggcaggatctctggctctggaatctcaaacctgaagcataaaggcttgcagggtgaggcgtgtgggcgaaaagaaatgacacagtctatagatctggatgggttgtggtccaaattcttccacatatcttctaggttaacaaatttgagtcaacattttcagaaagggagagaaagataaaaggagcttggataagactaaaatagactttagggtttatcagataagggcaggtttcagttctgccacttgtttgctctgtaagcccaaatgagttgtagtttttctctaagtcagccttttcctcatctgtaaaatggggaaaaaagacccacctcacagagttactatgagtattaaatggagtaatgatttataaattcttagtacagaacctgccagacaattgactcaataaatggaggctatcatttccaacctcttcctcaccataaaaacatgatggtcaccaccaccatcattagcctggatcaagaaagctttctgtttttattctggttgtttcctttcttgaaagtctctcgcagagccaaaggagaaccttgttctgtgtggctccagaaggaagacaaaatcaactggcatcaaactacagagagaggtggggaaagagcagggtgagaattagcccacatttgacacttccttttcattgttcagagcagccactattttctgtttgagaagctgtgtatgcagagatgcatatcatgtgcctataccatgtgtggcattataatgtatgcgtgtataatatgtacattatagattatgacatacacatgcatgaagtagattcaggagacctgggtgaagtgatggggctacttgtacatctgggtgaagtgcatttcctgatgaggaaatgggaaaggcaaaggccctgaagcaaaactaagcatggagtgctagaaggacaacaaacaggcgagggactggagtgggatggtggtaggaactggtaaaagtaggcaggggtcagatcagaaagaacttcataggcagtggggaggacactggattcattctaaatgtgctaaaaaagccatggcagggaggcatttgggcaggaggtgaaatgatctgatttttattttaagttgataattccagatattgtgcagaggtggagaatggattgtgttagagatgggtcagaggcgtgtgttagagatgggttagagatgggccagtcaagaggtcaccatcttccaaggtcagtgatgatgatggcttggactaggagaatgaatgagtgtgttgagacatacttgaaaaattgctgcattttcaagttggagctgacaggatatgctgatggtttgactatgggtgtgagagacagaactagtcaaggataactccaagtgttttggcctgagtaataggatgcatgttggttcaatttccagtgtagggaaaactgtgggagaaacaggttgagggaataatgagttccgtgtcagacatggtacgtttgagatgtccattagctgtccaaatggaggcatttacgatgagattgggactggagctattggcatttagaacttcagcattgaatgaaatcacctggggagtgagaggtctcaggattgcaccttggtgccctctaacacatagaggtcagaaagaagggaggatatagcagggagagtgagctgcctgtgaggtaggcagaaaaccagtaaagagtgttgtcttcgaagccaaattaaaaacaaacaaacaaaaagatttctaacaggaaggagtgaccagctattttatatgagagaaagcattcagcaaatggaaactgagaattggtcattggatttggccagatggaggtcattgggaacatcaacgacgagattttataatattcctgggagacaggggaaggatgagagccctggtggaaggggaatcaaggcagaaagaaggcaaggaattgaagatggtgcaaacaggtaagtctctggaccaaaataggcatgacccagttgaggggagaaattgcaggagcaaagcccaccatggtgaaaggaatgtctagggcctgaatacaagtacagtccaaattttttggggcctgagctaatgcaatttgaagtcctctttaagaaaaaagaatacaaagttatacattcaaaaattaggcatagaattgaatatttatttagtacaagaagagaaatcatgacaaatcgacagcactttaaagatgcgtgtatctttcttctgaaacctctttaagctaggatttcttaacctctgcaacactggcatttcgggtcggataatcctttgtaggggactgtcccacgcgtgataggatttagcagcacccctgtcatctacccactaggtgccagtagcacctcccaaatcatgacaaccaaaaatgtttccagacatcgcccaccactaccttaaaaaccattgctttaggttatttacttgacacgcttacatacaaacgttcctgattacaacccccatctttaacattctgcaatcctcagtaaccttcagcactggctggggccggaagtggaggatcctgaagctgaggcttctggtaaatccacctttgcctgagttgagggactggactcaaacagacacaggaagagtgcccatcataaaagaaaaaaaaaccagaaaagaagggtttggatgccagtagttaatagacttgattcttctcattacttatattttctcagtgcaataaaaagcaaggatatctgttaagagggtgacagtgggaggctgttggagttttgcatggagagaagggatgaaatagtcattctgcaaagtaagagtgagcggactgggattcttacgaatcctgctagaagtagggtagagcgagaccagtctgagcagctcaaagacggcttgagcactttataaagcagcatctgccttatcaccagaggtacctgccttataacaggtattcaagtagcaatggaaagtcagaccaaatgatcctactagtccttcttcttcttttgtgattctgtgatttttatagcaaagcaacctgatggcctccagtatatcagacaaaattattccatagcatcttcattcgcaagcgagtaagatccatcccacgaaataatgatcctgatggctaagagtgcatgcccaggataagagctttccatgctttatcttatttaatcatactcacagcatgggaagaaagtttaagaaagatcaagacgcttatccattgacacacagctggtaaaaattatattacccagattgaggaacattctacaaaatgcctgaccagttttacttaaaactctcaaggtcatgacaaacaaatgaagactgaaaaactgtctctggccagaaaaaaactaagaagacataataagtaaaagtaattatagtatcttggattggactctggaacagaaagaggatattagtggaaaaactggtgaaattcaaataaggtctggaatttaattaattgtacagcaccaatgctggtttcttagtttttacaactgtatcatggtaaagtaagttgttaacattaaaagaaaataggtggtttatgcgcggtggctcacgcttgtaatcccagcactttgggaggccgaggcaggcggatcacgaggtcaggagatcgagaacatcctggctaacacggtgaaaccccgtcctactaaaaatacaaaaaagttagccaggcgtggtggcaggcgcctgttgtctgggaggctgaggcaggagaatgacgtgaacccagtggggagcttgcagtgagccaagattgcgccactgcactccagcctgggcagcagagggaaactccacctcaaacaaacaaacaaacaaacaaacaaaacctctgtgtattattatctctgtaatttttctataaatctaaaattagttaaaaaaaacttgcctagaaacaacaacaatgacaagtgtgtgactaactccctggcattctaactccaggaagctttgcttctctgtgatgggtcagggcactggaatctgcaggttattctcctctattcaatgtgactgtgtctaaggtctctgctttctgcttttacacctacatgtgtcctccagctgcaaggcagcctggcacagtggagagagattgctttgaatccatgcaaacattggctgaaccttagttcccctattacttaactgtgagtgtggagaaaccactttctgtctcaaacttttggcttcttgcaactgtaccatgcaacccataatatctctttcctaggcttagagtcagattccaactggcaagtgagaaaagcaaagcagttggcacccagtaggtgctcagaaaacacaaggtccgccttcttcattctcagtgctaagaaagtgggagctcacccagcctctctctttctgacaagaacttctcatgtttaatttataggctggtttaggtagttgaattttaaataattcatagccttgctgttaatatttgtagttgttgaattcctttaataaaacatttagggatttcttccccctgaagtgtatttcatccggagaatgatttgttttctgaaatctgggactcggctgccctttcgttattttcttttctgcatctaatcctgtttattgctgtggcagaggtaagagatgcaagcttgggttttgctttgcatgggtatgcaggcagggatgtcaattcatctgtggctggggctcgtgaggtgggttcactctaagtgggggtaccatggcggttaagaacatcaacttcatactgtattaggtttgaactcaggcctgcacttccttcttccttgctgtgagatctcatccaggtaattattattattattttgagatggagtctcactctgtcgcccaggctggagtgcagtggtgtgatctcggctcggctcacggcaacctctgcctcctgggtttaagtgattctcctgcctcagcctcccaggtagctgggactcctggcatgtgccacgacacatggctaatttttgcatctttagtagaaacagagtttcgccatattgggcaggctggttttgaactcctgacctcaagtgatccacccacttcagcctcccaaactgctggaactacaggcatgagcaaccacacctggccttatccaggtaacttaacatttctgagcctttggtttctcatatgcaaaataagaatgagaacacactccttttactttccctgacatacctctggatttcaaaattctgcttatatccatggaggctgctttttctaatctctctcagcctcaacccccacttagtgcatttgatgtggcaaatagactcccttattaattctgttttctcatcaccttggcttgagccatttccacaagaactccaggctctttcctgattcccatgaaaccccgctggctttgtcatttcttagtacccctgggtttgagggaaggggaaggatgatttgggcatgctgcagccttttctaaaaggaggctccagctccctcttgaagatgcagaaggatctgaaatgcaaggcaagcttcacaggtgccaactgtattgttcaaagaatatactcccttttatagcacttatatttcattctctactgccagaatggagacacatgctgggtttctgcattcgtaattggggaagaacagatgggagagacgcagttggaagtaatactgtcattaaagtaatctatactgctcctaactctcaggcatgtgtgagaaggtgagtggagccacatggaccaagttcctttctgttcagtcctcatggaaattatggggtggcacatgactttggaagaatcagaaaattcacattcacttatggtattcctctgtgagtatgtttctagctccagagcctcaaagacaagaaaaggaacagattgatgatagtttccttaggtaaggagtggagtaggcattctagatagagagaacagcatatgcagaggtgtggagcctggaaataggaaatgttttaagtaatagtaagtagagaagctgagctggtcttgttagggaagcagcagaggatatggctagaagaactcgtgctatggggacgaggttcttgaataccaggaaagaagctgaaggagagttgctgtggcatggcagagcaaaggctgcaatcaggttcagtgcaggctgttactgactagctatgtgaacatgagaaagacacttctcttttctgggccccagtgcttcatctgcaaaatgggaatagaataaatggtctaaatagaacttcagtggcttgaaggacaacagctctgaacttcaggagaatgcatctaattcctgagtcttttggtcatgtaagtcaattctaagctgagcatatcccagtccttgttgactgagtaataataataataacagcatttgtaaaataatagagtgaccctttgctgaggtcctactctgtgccagacactgtaaagtgttttattattattattattattattatttatatatatttttttttacaatctcaatctcagtcttcatgaggtggtcctgagaagcccactgtacagatcttcacatctgaggctcagatagggaagaggataggaatttatgccacccaaccctgggtggcaggaccaagaattatgccagatgtcactggcagctgccacagcagtaatggcacctcctaaggcagagcactctggagaggtttaatgttcgctggctaatttaatccctcccactgcacctcaaagtggatcctgggatccccattttgtagatgagctaactaaggctctgtgagaagcaatcaccagctcaaagtcataaaaccagtaaaggctgaagctgagctctggcctcaggtctgcctggtattcaacctccagatgctgccttaggatacttcagccttcaaattcacacaggaggagcccaggattagtgggcagctccacagccccttctcccaaaatgtgagatgttctttgcaaacttttcttagggatgcctcattttgacagaacacactgccctctcttgccctggggagcagtccccattaagatatgtcaatgccattgaatacaaagcaaatatctgggctgatatcttaacatgtctgtagcagtgactctagactccctaaaagaccaaaaagttctcatggccatggtcatggacaaacttcttgggaagaggcttttgcagactagcacatcagcacaaggtctcaaagttgacttttcactgtttactcctgaggaggtgtggacataataagaactatgtatttggcctctgcctcaagttcctgacatagagctcccaaaacccttgtaatgtcctgactggtaagagcatattttgttttaatgaggtgattcttggtgggatcctggatagcttcaggatgggagctggtcaccagaaagggcaagccatgattagaaacttggaactttcagcctcaactccccattatctgggaagagaagaggagctggagagttaatcacgtcaatcttggctacatgatgaagcctccataaaaatccttaagctgcagggcctgaagagtatctgagttggtggatgcatccatgtgcctggagggtggtgcaccccaattgcatggggacagaagctcctgcacttgggatttttctggacctcacgctatgtacttcttcatctgtctgttcatctgcatcctttagaataaaccagtaaaaatcaaagtaaatatttccctgagttttgtgacctgttctgacaaattattgaacctggatggggagtgaggtggaaagtggcttgcagtggggttatgggtacccctgaatttgtagccaagtcagagggaactgtgaggatacttgtgtcaggtgtctgaagtgagggcagtcttctgggactaagatttcaaacccacatggagtttttgtcagaactgaattaaattgcaggacacttagctggtgtccagagagttagaaaactggttggtgtggggaaaacaatccctacatttggtgttggaagtgtggtgagtcaagatgcaggttttcctctagaatgtagccttatttccacatgttggggtttcatgttgttgtctgtccctgaccatgaatggcccaccatcagtgaaaagtgttgagccgtcaaagcaagatcacatctcctcagacacccaaagtcttgtggtaggaaggctgggagagagagtgaaaattcacagagtagcaactttgtccaaattagctcagaaatgtctcatcacagccatgaaagatggttactatatgattgtttccatcttacaggtgaggaaaataagctcagaaaggtgtaaacagcttgcccaagatcagtgttaagtgatagaggcaaaattttaaattcaagtctttggccgtctgacaccaacacctggaccctttggcctacattccatttcctcctatagtagaaagatgtgggccaggtgtggtggctcatgcctgtaatcccaccactttgggaggccaaggtgggcagattgcttgagctcaggagtttgagaccagcaacaaagtgagacccgtctctacaaaaattactaaaattaactaggtgtggtggtgtgtgcctgtggccccagctacttgggaggctgagattgcttgagcctgggaggcagaggtcgcagtgagccaagattgtgccactgaactccagcctgggtgacagggtgagacccagtctcaaaaaaacaaaaacaaaaacaaaaacaaaaccaatatgaatgtagttggtcttccctttctcacttctatccccatctttcccattgatccaagattctataagagtttaagaaatgttattgttccagccattggggctggaaaaaccctctatggagattttttttttctcccctcattattttgcttaagtgacagggaagtcttgtggactcctgtggattgcaaagaccccattcatattcatcacattcttactgcacacagtctgtgcatgttgttccttctgccccaagagctttttctcacctcctttccctttactcctgctcatcctgtagatgttagatcaactgtgactttctcaaaaaagctgtccaaccctctccataggtcccttgatcccagtgaactctcataacattgcactactttcctccctggcacatagctcagtttgcaagtattaataattggtgagtttttgagttaatgtcagccccaccccccaactagaccataagctctaagagggcagggtccatgtctacttggatcatgattgagccccccgttccatgcacagggcttagattactatagatgacccatcaatgtttactgagtgaataaacaaatgcgttaaagcataggacgtaaaaacttttgggtctggagacaatagaatttctgaacttgtgtcttaaagaggaatagctttttcctcataacttgttagaaatgcagaatcccaggcctcatcccaaaccctctacataagaatctgcaacttgccatgttctggtccccagaggattcctatgtacattaatgacttataaatactgcagaggagaaaaagttggaatggaaaggtgaagtagcctgtgttaattaattgatcatgtaattggttaattataaaagtttgtaaaattattctgagcaccttctatggatctggtactgtgttaggccctgggactctggcatgaacatgggagatatggtactagcctcaagatagtgcctgatatggtttggctgtgtcaccacctaaatctgaacttgaattgtatctcctagaattcctatgtgttgtgggagggacccagggggagataattgaatcatgggggctggtctttcccatgctattctcatgatagtgaataagtctcacgagatctgatgggtttatcaggggtttccgcttttgcttcttcctcattttctcttgccgccaccatgtaagaagagcctttcacctcccatcatgattctgatgcctccccagccatgtggaactgtaagtccaattaaacctctttttcttcccagccttgtgtatgtctttatcagtagcatatatatggactgatacagtaccccatacctgtgtggatgggcaaagcacccagagctagcagagtagagggagaggctgctcattgagcaggaaacagggagggctttctgcaggtgactagcagtggagggcacagggggcagcctcatagacaatgaaatttcctgtcctgtgtcacagtcttgaggctgggggatggagtcagcaggttgttgtaataatccagactagaaatgtaaacaggtcaccattctttctctcccagctcttccctgaattctcatgccattctgaaaaacctgcctaaaaccctttatgaatcagataagggccagattccataggcttctttcaaacttttttttcatattttttcatttacattctgcctctaaatgtcaatcttctaccttcttttctctctctgtgtttccctcctttccactgtttgccttgctagtgtccctctggcatctccattacacggactattatgcagctatcagaaatgatgtttacaaagactgtgtaataaacatggaacatgcttaggtttaataggaagctggtgcagagttgtatagacatatgattacagtcttataaacataagtctatatagttaacaaaattttaaaaagcaaactccagagtgagtcaaacaatatttatatgtgcctggggtttaaaaatatatatatttgagatgtttattttctatctttttatgactagggatttctttttacataataaataaaaaccacaaatttaaaattgttgctatttattcactgtatcattttgggcttttttttttaaacttccctgagcctcagttttctcatctctaaaagggagctgacagttgggcttcccacagaggatgttttgcgattgtactcaccaagtgtgctatggcacagagcctggcatgagagtaaaacctaaccccatagcagtaattatcatgtgaggatcagttcccagcttacctgattggtatagattgaatcaaaaacaagaagtttgatgtggtagggatggaggtggagggcaaggagttatccatttggaagtcctgattttgtggctatgtttgcccctaattgttgtgcgaccttggcaattcttcccatctctgggcttttgtctctccaaatgtagaagagaaatggaacctcaaagatcaacataatttcctcttacatgtctaaaagataatacctcaatttccttgggaacacactgtgaacgttttaacaatcctaaatattctactggacaaatactgcagcctctttctaatgtcccttaactccctgagtttcatggacctatgaatttttcatccttgcttcttaaaaacaacaaggtccctcctcctctgatgaccacagaacaattcttggttgtgtcaattgtttacaaaaacatcatttttttttttttttttttttttagctgagagcagtagctcacacctgtaatcagccctttaggaggctgaggcaggtggattgcttgatcccaggagtttgagactagcctgggctacatggcaaaaccccatctccactaaaaatacaaaaattagccaagcttgatggtggtctatagtcccatcctctttggaggctgcagtgggaggattgcttgagcccaggaggtgaaggctgcagtgagctgagatcacaccactgcactccagcctgggtgacagagcgagaatctgtctcaaaaaaaaaaaaaaaagtaattttttaatattaggaattagagtgtggtggtcatcagttcatggctgacagaaacagcacttcctgctctttgcaatttagttcttataatggacaagtcttgtttcaaatgctgcctccttggtattctgtgtacaatggaaatgggggttggattagatgctctctaaagatggtctgagctctaaaagttttcttcctggacagcagcagtttccctggataaaggacctttttcctgagcatgtggctctgtctcagaagcagcccctctccctggttccccagtagagcttccaggctcagatgagtagggccagctggctttgctctacatagaggccctaaataattttagtggcttaaaagcagaagaatggttctccagctcctgtaagaggcagaattaacagagaataacttaaagggaacagcatgaaagaggccaatggaaagatagaaataaaatgaagaatgggggcaaccaactttcagggtctctcaaaaaaaatcctgggtcaggatcccacctgtctactgcaagctcccttcttcctgctcacagtgccttcttgccttaatagtacaaagaaaaatgctttaccatgatttaggtactatgctaagctcttgaccatacatgcatcatttaaccctcagttacaatgttggctccatgagggcagggggattttgtctgatttgtttacagttgcatcccattttctagaacaataccaggaccccggtatgtgttcactgagtatttggtgaaatgatgaatgatgacttgctgaggtcactacgattactaactccattttacagatgaatacactgaagctcctagaggttaagttacctgctcaagacaacgtagctagtaggagcaaagccaggattcaagtctagctgatcttaaagcctgctttattttagactatgtcctcacaggaaatatccatctgttttagtctattctcacactgttacaatgaaatacctgagactgagtaatgtataaagaaaagaggttgaactagctcaccgttctacaggctttataggaagtatggccacatctgcttctggggaggcctcagggagtttctactcatggtggaagcaaagtgggagcatacatctgacatggtaggagcaggaccatgagagagatgggggaggtaccacacacttttagacaacaagatctcacaagaattcactatcatgatgacagtatcaagggggatgctcttaaaccatgagaaacagccaccatgatccaatcaccttccaccagacctgcatgagcctgttctcacactgctataaagaactacctggctgggcgtggtggctcacgcctgtaattccagcactttgggaggctgaggcgggcggatcacatggtcaggagattgagacaatactgactaacacggtgaaactctgtctgtactaaaaatacaaaaaattagccaggtgtggtggaggtcgcctgtagtcccagctgctccggaggctgaggcaggagaatggtgtgaacctgggaagcggagcttgcagtgagccgagattggaccactgtactccagcctgggcgaccgagcgagactccgtctaaaaaaaaaaaaaaaaaaaagaactacccaagactgggtaatttataaacaaaggaggtttaattgacttacagttctgcatggctggagaggcctcaggaaacttacaatcgtgttggaaggggaagcaggcaccttcttcacaaggtgtcagaaaagacacagtgagaaaggagggaggaactggctaaacacttatctgatcttgtgagaactcactcaccattatgagaacagtatgggggaaaccacccccattatccaataaccttccactgggtccctctcttgacacatggggattatgggaattaaaattcaagatgagatttgggtggggacacagccaaaccatatcagggccccacatccagctctggatattacaactgaacatgggatttgggtggcaatacaaatccaaaccatatcaccatctcctacttctctattcacatctccttcctctctcacagaagttcctctgccctagaacctcttccttccggaagtcttttcttactacttcctttgaaggtgggactcctcttggaatgacataactacaaccctcctatgcattactaagtcaaaagctatcttccccagaaagggcacttgttattttccctaagctatgcctgaatactttataccttgaattattattgttcataaacatgtgtacccataacaaattataagcttttcaaggaaggccctgtgtttggttatgattaattttatatattgctacaatgccagattcataatgagtttttaatcatttttttcaataatgactcatttaagccttggaatcatagactcagggggcaatttaggtgtgcctatcaaaatgtcaaatatttttacactttaacatataattccatttgaaaatacttaaaaatactaaaacctagtcacaaaaatgcatgcacaagtctgtgtattgttgcattgtttgtaatagtaaaaacatgtgataatgtaaaagtccattactggctggtggtgaaatgaatcatgatacatctgtgttatggaatattaatgagctgtgaaaaagaatattgtagatctggatgaattgatatggagacatctttaaaacttcgtattagtagaaaaagcaagtttcacaaaaacattcagtgtgatcccaatcagattaaaatttacctatgtaaattcatgtcaacagttctggggataagcatatcaaactgctaagaaatatgtactttggggtgggctggaagtttggagactgaaagagatttctgcctttttattctgaaaatacttcttaaaaaatggtggcttaaaacaatagactcacaggacatgaagattggaaggggccttatagggcagaggtggtgcagaaccttccacaggcagtattaggttctttgcatatatttcttacctatatctcataacaaaccccaacaggtaaggttcaacaatgccactttacaaacaaggacattaaggttcagactcaaacaaagcccgcctaaatctcaaccttgtccccttctttccaaggttataacagtacaattctaaccaaaattttattttttagataggactttgagacctgttcaggctcagccagaagtctggaagtccttcctgtgctgtctcttctaatcacttctaacatctggaggttatcaccacagccagccaatttgttcactgaaggacagaagctttgcattctgtttcttcgcccccaggtttgggttgatcatggtaccagatgctccttaaccctacaatgagatagtcactcttggaggggccaagtcagctattagacggcttctcttgatgcccttgtctttacagttgtcctggaaaaaccagacttctgccttaggcagagtggttccatttgaagttatgagaaaaggtgagtgaggagtagatagctatacaaaactattttgtgatatgacttggtgttctttgatgaggcttggcagagacgtacaccaactttcctcagcttttacccctggagatggagatttctttagggactcagatgagtggttgttctgcattagggctgggaaaatctcaaaaagagctggagggtggaaatgaagaattcaacttggaatccttaaatctcagacttggaagaaagctcagcagaggagatttaatctaacttctgacccatgcaagggttctctctggagtgtccacatagagcacaccttgctccagtgccagggaactcaccacttcagtgttgaacaggtcttactaagagaaggcacttgctgatggtgcctagatctgtctctccagaagccatctcccatgtgctgtggagcagggccctgaggtgaaggcactggaagcttctcctcttgttactggaaaggggtcccaatccagaacccaatagagggttcttggatcttgcacaaggaagaatttaaggtgaatccgtaaagcaaagtgaaagcacgtttattaggaaagtaaaggaataaaaaatggctactccaggctaggcacagtggctcaagcctataatcccagcactttgggaggctgaggcaggaggatcacctggggtcaggagttcggaaccagcctggccaacatggtgaaatcctatctctactaaaaatataaaaaaaaaaaaaaaaaaaaaaaaacttagctgagtgtggtggcacgatcctgtaatcccagctactcaggtggctgaggcaggagacttgcttgaacccaggaggcagaggttacagtgagtagagattgcaccactgaactccagcctgggtgacagagcaagacttcatctcaaaaaaaaaaaaaaaaaaaaaagaatggctactccattggcagcggtggcatgggctgctcagcttcttatacttattgttacttctttattaattatatgctaaacaaagggtaggttattcatgaattttccgggaaaggggcaggcaattcctggaactgagggttcatcccctttttagaccatataaggtaactttctgacgttgccatggcatttgtaaacagtcatggtgctggtgggagtgcctcttaggatgctaattcattataattagcatataatgagcagtgaggatgaccagaggtcacttttgtggccatcttggttttggtgggatttggatagcttctttactgcaacctgttttattagcaaggtctttatgacctggatcttgtgctgacctcctatctcatcctgtgactaagaacgccttaaccttctgggagtgcagcccaataggtctcagcctcattttgcccagccccgactcaagatgaagtcactgtggttcaaatcttctaacactctgactagtatacgacttccaaacaagtcactcttgccacttaggagatctgagctgagaaccctcagaatcaaatcccttattttacagttgggaaaaatgaggtccagagagccaatattttattaatatctaagtctcatatacccatatttgctttcttaatataaaagaatcatttcctgtcttacagttaacaaaatatcagatattttagtacactctgctcagagctacagcccctgcttagtcatcagcactaccaccactaccatcatcatattaataattattcagtgtctcctatgtgctaggcattctattaagtgttttacattgaatgatacctcttgagaaccttatgaggaggagtgaggagtctcccagttagagaaggaatgcccacctatcatgatagtcatttttcaagtagctgtgtaatggggcagaagatgagcttcttcctgctagatttcatcacctggggcttgtagtctcagaacaacagacaagtcaggctccttttccagtgcctggaaggacatgcagatgtatgtgtgtacacacatactcacatgtactcatacaggctctctgctacacagatacgataaaggaagcttgggtctgtctctgggaaccactctcttattaggcattacctgcagttcctgagtacttcttccagtttctcagacaaatctaaatagaaaccctgctactcctatttttccatgtgtggggggtggggggatgaacatattgtaggctgtgattaataatttaaaaaattattaagaaagatcaagcttcctgatgttcagcttagaccatatgtacctcaccttccctgaactatccctgtcctgcccccatatgcaaggagatacacaacacaacacacacacacacacacacacacacacatatatacacatgcacacatgcacatagggatgctcatacattcaaaaacatccagtgttccttcactgcctgtaaggtaaagctgaaacactgtagcctgaacatatgaccctttatgatttaaattccatcctttcttctgaaactttcttcctccattccttatcatgctccatccaaactggtctactgtgcatgccatcccatcctggcctcccagaaagctctttctcaggtggtgcccctgtttgtaatgttgttccctgtatgatcaccaagaccaagttcaaatactacagtgtctaagaaaccatcaatgatgtcttcaagcttcctgctgtaacctctttctcatcagagctcttaaaatcattttcaaaactgcttcaaaaacatattgatttcaataatttatgcagttcccttaatcgttgccaccccctgccactgcaagttagagctttctttttggtgcatagatctctttggtgctatatcttctatagccttgccagcttcatctgctcttgtagaaacttctctgctctttcctccttctttttggtccctgccttcatgttatcgagttccatttcaacctctttaccttgataaaacacatgtacataattttggcattgctattgtttttcactggagttacaagagatgtttgaccaatgctcataataatacatctagccatgctgataataatttaaatatggcatttaattactaagctccaggcactatcttatggaccttatatactttgcttcatttaagtcttttccaggatcgtgagtgggtaactcttttaaaattcctattttacagatgagaaaactgataactgaataagttaactcaaggtcatccacagagtgacacggctgagatttgaactcatgtgtagctgactccaaaacccaagttcttaatcactttatcagaaaattaccaaaaggcatctaattagttgcatgcaattaaatatatatgagggagagggccatcaggagattatttagaaatagaaacaaaataagatgtatgaaaacaaagataaaagcaagaacagttgaacagagtctgagaacaatgaatcgtggtttacaagttttagaaaaactaattagctggaatatagcaaagaggtcagctctgagacatctatccttgagaaggctaaggaggagtaccaaagaaacccattttcattgcagattgcagaaaaccttgagcgtttcactgaggaatgtatgtggcagggtatctctgttgccttccatccatacctctgcttttattggggtggtctccaccacctccctcatcagaacctctccctagggtgcatggcttctgatctcccaaaagactggtttctactgttaaaggagatcgtgcatgtggagtccttaacaggtgagacagtcacatggccatcctgaaataaatgtagagccatgataagccttataatcacggggtgtcttgttttcatatatttatcattactaacaggaagctggtgggttttgctttcctggcttttgctggtgttgagattccttttttaaccagctctggtaactcccttatgtaacaacacatgcataagtattcacacaattcactgctttggattgatcagctctatctatgagaattgtcttggccacagtgaatggattatagttacaatagaagtctgtactaggtggtccttcttttgacacttgcggactcccaaggaatggtggctggactctattaggctccaaactctcatgtgcctgagcgccagctccctctctaaacataagcatctcggggctggaggtggggggaaattttctgatgcatctttctttgccatgtaattcctaccccaggatcatgctcacataagtgttcttggaatatgtgagtaagtgactgaaaactccattgtactgccctgttgctgcataaaactggttgtcaatgccgacagctccctgtggtgtttttcttccctttgggaaatcacaccaatttagctttggctactgttccctccgtataccctttcatgtgtatgcaacaacccacagtatctcctccttgctttcaacttgctagagaccagcctttctcatgacactccacagcttgactcagcttccctccctgttgctatccctgatctcccaactgcctccctcttccaaattatgtgaaaacaacgaccatttactcaatacctactacctggcagatgccgtatgtgaaaaacctttctgggtcctcataacagcccccagggtaggtctaccagtgtctattttacacatgaaaaaactgaggcacagagaagggactttggaagcctcagagaaacagctgaaatgccagtcagctgtgattgacaccaaagtccagcaatttaaccattacagtataatatatctttaaatagaaattccaattacatttttcagatattctaaaaaaattccacatatagatttgaagactaatgggcagtcatacacccctgagctcatgtttactcagaaatctttgtcgtaacagctgttcctcccctaaccttgtatgtacttccagtttctgcagcagatactcaagcctaccacgtgcaagggagattgctgggcactgctttggagcaaagtgtaatatgttataaatcatacactccatgagtttacaaaagaacagagaaatgaaggggaagaaagaaataaaagaaaactgtattaaaagagttgattattagaaaatgcttagaaaggcaaagacttgtggaggtacaaaggaatttgtcaggtacagggtaaaaaaaaaaaaggatgtttacctagctgacctgtaagttaaacactgtattaagggcgttcatagcaacagtggccattttaaagcatctattatgtactatgagttttttatgcatttttcatcccttcacaagaagtgaacaaaataggaattctgatctctattttacaaaggaagacactggaagcacagagaggtgaaaaaaatcacttaagtgtacacagccattaaatggcagaatcaaaataagaatccaggcctgtcgtggcctgcatttctggcattcctcacatacgcctcccagtgggatccagcatattatccccatttacaggtaaagaggaagtggcagaatgtcagtgttggaaaggacttgggaactagaatgcttgtttaggggaaacaaggaaggctgtgtgcagatgtgctggacctggaaggactaataggacttagtacacagacactgtaaaagcattcttgagagaaaggtcttcatgagaagaggcggaagtgtggcagatgcaggacgaaaagaagatgccactgactagtgtagcagcacttttaggctgctggaagctgacatggctggaatcctaagtcaggcctagctacaatgcattcctttggtatagattatttgctttgaatcaagggtattgatgctgcagagtcaattctgcaggaagtgaaccctaaggagaggcactgagactttttttgggagatcctaaaaaagccagttcacctgctccaaccacgaggcacatttgctcccaaacattgactctgtgctgcatcttggaatattttgcacgtatctctccctaacctggagaaatacagtccatggtgcctttgggaaacaaaatagcacttcttccccactatctcatctaaacaaccctttgctgactaattgaattactctggcccacaaactgatagacagctgctaaaaatggttattgcattattaattcgctccagcaatttcacattaaacctatactgttaataatttttccccttctatttcttccctcttaattagactatttaaaactttgaaggaatagtctttccatgctaaatggaggcatcgggcaaattacatttttgattgaatacttctctgataggccagcaaatgagactgttgagttgttaattattgtcagagttccacacgacacctgctaatgaggcagtcaatctcagctgtcagtcccctgatactaatggaggctgatgggatgtactgggaaggatgcttgctggaggtccagggtgtccagttccctggctgtaaatgcaaggccagtgacttcccaattgctaaagcaaatgggaaactgtgatgagtggggaaggggatgggcagtggaacagaggtgaggacagccaggtgaggagagcaccaggtgggcaccattgggatggaccactttgttgttgttcagtaaatactgctggtatttttaatcattgctgatagggctgtgtgtctgcagtttcttggaaggtgatggatataaggaggtgcctattgagcagtcagaagacttcttaagacccctgacctggactctgaatgacctagccccaggctccagaagatgttttgaattttcttccttatgtaaccagggttatgctggtgtggactgagagaggtgtcaagtctcattcagcaagactgggagtgaaaaaaaggggatggcacccaagattgggtacccaagaactctatatactttttaagcagggttatgctataactctatatacttctgagcagggttatgctggtgtggattgagagaggtgtccgatttcattcagcaagactcggggtgacaaagaggggatggcatcaaagattgggcacttgggaactctatatttagtctgggacaaagcaaaagctcagtagaagggcagggaagggagaaaaattggatttgactaataaatatttactgagtactttgtatgcatgataaagacttaagttgtctgtgcaaactcccaaggcagacattttttgggaatcatccttgacctttacagcgtctacttcacaactacccacttcccccgcccctccattagattgcttcctgaggctcatggattctccttcaccaatgcttcggaaactcattatcttctccctctcaatttttcctcctccaggcccagtccttcccatcaacttctgggttactgaccccaatctaattattgctgaatctacacctcccaccctctgccaagtgacatcttcgacctcatctcctactactcgccccagcttatgcagctctccaacatgccacgtacactcccctgctctcctctgagcttttgtttcaccatctctagaacagggcatcaacctgctgtgacgtacctggcagggttctgatcaacacacactggcttccttctccttgagcctttatcgctaagcctcatcattcaaactgatctttatgctttcctgccatcggcctatcccttcgagcctattcattttattatggtggagacatgggttgtgggtggggatggggaggttggcaaggaaaggctagaacatccctgtcacaggtgcgagtcactgccccacagggagacttccctctcatgggggaagacatgaaggcagacccctaacttgggaggggcatcaggcaacaaattattgaattcttatgagttttaaggcagattcttaggttttactttgcaactttgtgggggaatatagttaactacattgagcaaaagattttaacttctgaagatataatctggccactttgttaactgcacatcgatgccacaagtgattgttgacagattgcaaggtactggacactgtcttaggagctaagatatcataggtgtcaaagcaggcaggatctctgcccatcaagagcatatattctaatttgggaagcaaagggccaacgagtaagcaagtaaatgttcgataatactaagacatacaaatatcacatctcttgtgtaattatgaggcatgggagtgatggtggtgtggggttgagtaatttcaggaaaatattaagaggtagatttgagctgagatcttaatgaagagaaatccaggtaaatgaacgtaggggtagagagagtaagcatccaggcagtggcaatagcaatcacaaagggatggagaagaatatgagcttggatagttgcagggtcagaaataacgctggtttggctgaactgtgagaatgaggggtggtagggggaaggggtagtagagtgtgagtttgaagagataggaccttagaggccatggtaacacacttgaatatgatgccaaggccaatgggaagctgctgtgagtttaaagcaggggcatgacatgattggatgcaggtgctttctgaagattactatggagcacctcttatatgtgaagcccggtgccaggtggtggatgcacaatgatgaagtagatacagacatcaccttcttagagtgccatctaacaatggagacagacacacagccaggtatctgatgcaatacaaggacaaacagcctggtagtggaccctaatggctgctctttcctctgatagtaatagacaatttcattgggtttttggcttccacatttcctaactttccctgaagctgggtgtggctgtgagattacactgtggctaacaggatatatgtggaagtaagtgatagcagctccaggtttcctccttcagaggcagctggttctacattctgctgctcttccccctgcttccatcctactgcttcaaatgtggatgggagagttacatgcatgtgccctggaacaccccatgagagctagacatcagggacgcaggaacagaaagctacaggaacctggagttctgcatggagcactccatgcaggagccattcagttctgcatggacacagtaaagagctgcaattccaggccgggcatggtggctcacacctgtacttccagcactttgagaggccacggcgggtggatcacttgaggtaaggagttcgagaccatcctggccaacatggcgaaaccccgtctctactaaaaatccaaaaattagctgggcatggtggcacgcacctataatcccagctactccagaggctgaggcaggagaatcacttgaaaccaggaggtggagttttcagggagccaagattgagccactgcactccagcctgggtgacagagcgagactctgtctcaaaaaaaaaaaaaaaaaaaaaaaagagctacaatttcagtcctaggttgttacttctgtacttttacccaaaagacaaatctccatctcatgtagaagcaggctctattttgggtctatgctattgtagactaatttaatcctaagagttagctgtactaataaagtgttggcaggagagggattttttacagacattcaaaaagaaaggaactaactccagcttccttaaaacaaatcgagcacccctcctggattcttcttattacctactcttcatacctcccagtcaatgctgtaaaattggttgagactggctttctctgagaactctggatgctgatgttttttgttttcttgtcttccctctagtctacttcaagcagacagaaggggagccggagtgaaggtgagtatgaggcagtcccttcccgcagagaagtctggagattctgcctcatgtttatgagaaaggcaagccaagacaagtttggatgggaaacaggagcacttaaggaattaaactacagcattcatttcacaagagggggaaaagatggagaggaaaacagaatctaacaaaatggagatggcaacccctttaaagctattacttattggcaaggattgttcctgaattttattaaggaaaaaaaaaaggcaatgaaaattcagcatttactaaaacactaccatttaaatggaataggaagaacataccaattatgctggaacccacatgagtctgtacaggatgctacaccaggcaaaaacaaaaaacaaaaacaatactgacaggatgatgtggatggcctgtctgactgttctggactgctctgtcttctggctaaataatgtcttcaggcagagataacaataaaaaaatttaatacttggtaaatggagggtaccaccaatcagccaatctgaatatggtggggccctggagacctcagttgtgcgaagtgttagtcctttttttttttttttttttttttctggatcaagggcaggtctggggagtaactagcagagggatggaggtgatcagggcacttgggggctcaggcagcagctatttaaaaaccaatccagatgcaattcaatattttaacaaaaccacacagtgtgctgttgtatatttgccgaatatcatcagctccatttccacaaatgagaagctactgctccaaagaggtgcctcgatgccttggatcaaagaagcccgatttcttttctcaacagtcacagaggtgccaatgttctgcaaattttcttccaagccccctaatgagcccaggagtccccatcaggagcaatgccagctgcaactaatgcacacaaaacactttgcaattaacagagtcgagtgtgtcattaagacaaccttatgaggaagacaatactcccaagtaagcccggaagcataatgaagctaggaggctagtatacacctaagtgatggccctatagcaaaatggcttttttgcttagcaaactaacacaggaacagaaaaccaaatacagcatgttctcacttacaagtgggagctaaatgatgagaacacatggacacatagaggggaaaaacacacactgaggcctttcagggagtggaaggtgggaggggggaagaggatcaagaaaaattactaataggtactaggcttaatacctgggtaataaaatctgtacaacaaccctccatgacatagtttacctatgtaacaaacctgtacttgtacccttgaacttaatataaaagttaaaaaaatggcttttgaattcatttagctccactgtctgaggcatggcacagacaaatgatggttgttccgtgattttctgttgatgtttatatacccccctgtccatatacagtggctgttgtagaagcaggtttggttgcctagagtcaggttgttacgtgtgtacatcccagctgttttcccgttctagatgtgcaaactcagggaatgttcttaaactctctgaacctttatttttcttacctgtaaagaggttaggggagtactatttgccctgctaggttgttgttaggagttacgcattaggagtaattacaaagggtgccaattaatggtaattcccttagcaaatcttcatgtctgtgctggttgaacatacacttctaggtctcacattttaaatgaaatagatagcagactgaattccaacaagtccatctcatggttcaatacatagaggatttgaggctgagagagtccagtgacgagaatatgggttttaaagttctatataccagaatatgagtcttatcccttctgtttaaaatagctgtgtgaccttgggcaagtaacttaacctctctgaaccttatggtctttaacataaaagtaatactgcctacgttatgggaaggttgtgagaattaagtaaagtaagctatgaacctagtatatagaagacactcagtaaatgtgagctttttaagacatttctgtatttccagaagcatgttcctctgcaagtcacaaatggactttggcatgagccagaaaagaaagaaaaaagcaaaaagcaaaaaaaagaaaaaaaaagacttccagtcacacagtctaaagcactggtcttgccatctggcagaacaggattcaaattccatttccatcctttacttgctgtgtaatagaggcaacttacgtcacctctctgtgtcagtttcctcaactgcaagataaggaagtgatactgcctgaacttgggggtatgtttacatgctccctcttgttttgagcattaactagttcatgtatttgtttagtacgatttatgtttaccatgtttcaggcaccgttatcacactttaccatctcagcccactaaatttaatctttatatgaacctttgaagtaagtactattactattcctattttacaggtgagacattgggaaagagatgttgagtaacttgcctgggtcacatggttagtgaatggcagacctgggatttgatcccactgcattctggctttggtgtcagtggtcttaattaccgagctgtggggcaactaacatcatcaccaccatcaccactaccaccaccacaccactaccactaaaaccaccaccactaccaccaccaccactgccaccaataccaccacctccatcactaccaccaacaccatcgccaccaccagtaccacaaccatcaccatcaccaccaccaccactaccaccatcaccaccaccaccaccatcaccaccaccaccactaccatcaccactaccacccaccatcaccaccaccaacattccaaccatcaccataatcagaattataaccactcccaccactacaatcacagccaccactacaaccccaggtactgccaaaccacatttattgtgtgctgatgaggtgccaagcactttacatgcatggtctcattgcattctcacaacaatcctatggggtaggttaagcaatttgcccaaggtcactcgatcagcaagtgctagtacttgcacttgacttaggtcctctggtcaccaaacccatgctcttggacactttattagattgctgaaactgcaaaaagcacccaacatgtcatcaggcacataactaacattttccagagacatttctctcttccaggaattttcaagctgtaaagtttgggttttctgacagcccttgagcacttcagtatcaatcttttcaccttgtctaatttgaagggtgaatctggtggcttcagatgacaaatgaacccacacacagcttcacctcgttctcatttaccaaaactctgcccaaggcttggcacaccttgtttatgtctttggaaaagaaaaaatgatgagcaaaggtaggtggcagagccctgtctagctccttaggggctggacaaattgttagatgtgagagcacattgatgggaaacataggactctagggccttgaatataagaggtgtgaaggacccttcattgtttgaattgtatgtgtcggatttttaatttggtttaactttataaacacaggcctggtaacttatgagaggatcctgggctcagccaatgctaggacaacaaccttgatttccccttctatccatctttcatactgagctagaataatggttctagaatggaggtctggtaattctttttccgccttaaaatgctttcatggtttcagattgccttcaggagaaagacaggacccctgaacataatctaagaggctcttcatggttgactcctgagcaaccactcacccctcagcttccttctcccacctccttccttattccctgtcaccacccatcactctagtcatccagggcaatctgcctgctcctgaacatgttagatattgcatcctcttggtcttcttctgactctcacacttccctcagatctcatttgggacttcattttcctctgggacagttcacatctgcctattctctaaacctttatttactggcactatctattatttctctaccaaggccagggacttgtattctctactgcctagcccagagtctgacacataatgagtaggccttccataaatatctattggttgaatgaataaataaatgagcatgtccaaggatcaagttcaagaactacattacttttgggggagtgggtagaaagatatgcatttgaggtttaggacaagaaaacattgcaaaaggaattgaaattaaaaaaaatcagtaattgttctctgattcctatttgaccctggtattatacataattaatttgataaatatgtgttagtttttactgaattgccaagcaacatgctgccctcatctgcagagataaatgtgacatcttttctgccttcataaagttcactgtctaacatgggaagcagatacactgaaactaagctcacaaaatatctgtcagctgtttgaagacatactgtgtaccaggccttttcatacataatttctaattttctcggcaacctttgtgagataggcattgattccatttttacagatgaggaaacaagcacgcgaggtttaagttggtaactttcctttgttcaatcatgcagtggagtgacagaaatatgaaatgacaacttcttaacacctgtggtctttctactatactaccttacttcaccctctcctgtactgtaatacactagaataccactttgcacatttgcaatcatttttatgcatgccgcctcatgtcagtgccatgaagcactgtttgcaatggtagagaaggatgctaatacaatccttggttgacaaatgggaaaactgagaccctgaaagttttggtcctatgttaatgcaaatcagaacagaatcctggtttcctgatggtggagacttttccttgttactctaaaaatacaccctccgaaatcatgcacctccagttccaaatacgtaactcctttggtccacaaggagcactgacattacctccccagggcggatcaacggcactgcccttgagctggctgctggcagtttcacaggccccctgagtcctcaacaataccccccactccaaagcagtgcttatatgaagtttgatttcaggcctttatccaattgctccccactcagctagctgaaagggccctggagatcatggccagccctttgccccatttgaggacaatgcattggcccaaaacacaacacattatctgggcttcaatatattatcacaatattgttttcttcagactgataacaattcattgctttaagtacacaggggcataattccaaaagagaattgattatctttctgagataactcttgctattaaaaaaagggaatattcccaggaagggatttcctttgccctccttgtttctctaggtcttatttccacaatttaactcaacaaacatttactttctttactatgtgccaaacactgtgttaagatttgaaaggacaaggacaaatatgaataggacacttcctattagggtacccactctgttataaaaagaaagatgtgtgaaacagtagtactaactcagaaatgctggagaacacggtggtaatcagctcaggctttgctggtgggccagtcatgggttcaaatcccggttctgtcactagctggtacaattttgggccagtgatttaacctcatagtctcaattttctcatctggcataatgaagacagtcatagtgccaacactgtggccttatttaacaatgaaatagtagctagctattagtagtagtagtagctatagtaagatacatggtagctagcacacagaaaatactcaataaaataatcacttttattataacaataaaattattgttttattatttaaataattttaactttaataaaatatttgcttttgttatttaaaaaatttattattattatcattattccaactcttctgaccctccaagagtcaccctggaggacaggcattatatgcttttcttctttgtaactccccatccttcgtgtctaccaaagggctcatcacacatttgattctcaataagatttagctgactgtattttagacagatacagctaaacagaaataaaatcatttgtgtcattcttttgtatttttttttccaaattgagctaatcacacacacatgcaaatcttgggtggcaaaaacctactatgtacaggcctgttctgagtgctagagagggaaatgaatacaataccaatgtggtctcataaagctcacagctccacagtgaagggaagcagtcagttttcacaatgactcaggtggaaaaatgataacaaatacgtcatgggctgcatgatgacgtttccgtcaaccatggacaaaatacatgatggtgaccccatagcatgacaacagagctgaaaaattcctctggcctagtaacattgtagctttcctaatgtcctagcacaatgcattactcacatgtctgtggggatgttggtgtatgcaagcctaccacactctctgttgtataaaagtatagcacatacaattatgtacagtacataatactggattatgataataaacaactatgctactggtttaagtatttattctactatacttttaattgttatttttattattttgtagagacagaggtctcactatgttgcccaggctggtttcaaactcctggcctcaagtgagcctctcgcttcagtttcccaaaacacagggaatacagttatcagccaccatgctgggcctttttattgttatttgagagtgtagtcctactacttattaaaatcagttaactgtaaaacagcctcagacaagtccttgtaactgtaagacaacctcagacaatacctccaggaggtattgcagaaaaggcattgctatcataggagatgacagctccatgtgtgttattgtccctgaagaccttccagtgggacaagatggaggtagaagacagtgatattgatgatcctgattctgtgtagtcctaagctaatgtgtgtgttcatatcttagtttttaataaaggagtttaagagtgaaaaaaactatttataaaagctcatagaatgaagatgtaaaccctcatgtacacccatatgtgtgttttaagctaagtgttactacaagtcaaaaagtttaaagaaataaaacataaagttttagtaatctaggtttattattgaagaaagaaaattttaaaataaatttagtgtagcctaagtgtacagtgtttataaagtccccagtagtatccggtaatgtcctaggccttcactttcacccactactcactcactgactcacccagaacaacttccggtcccgcaagctctactcatggtaagtgccctatacaggtagataattttaaaaaatattttaaaatttctactgtccctgttctatgtttagatatgctcagatacacaaacatttaccattgtgttaagttgcctacagtattcagtacagtaacaggctttacaggtttgaagcctaggagtaataggctacatcatgtagccttgatgtacagtaacctttaccatctatttttgtgtaagtacattctttgatgtttgcacaatgaccaaattgccagacaatgcatttctcagaacaaatccctttcgctgagtgacacatgtctgcagaagacaactgaggataccagtttgagatccattaagacttggttatggcatattgtttagcatggtatttgactctgctagtgtgcttagaattttctggtgaattatcctgggataatctgggatacttgtgattctggcctgacttttttttttttaagtcttttattctggaataattttagatttacagaagagttgcaaagatagtgcagataatttctgtacacctttcacccagcttccattcagcttaacatgttacataactatccaggaagaacagatgtcctagtttgagggctgccagcaggagaatcccctcttactcagagaagggtgagctgcttgttcttttcaagccttcaagtgattggatgagactccctaccccccacatcatggaagacaatctgctttacttaagctacagaaaaaaaaaaaaaaacaacttcacagaaacacctagaataatgcttgacaaaataattgagcatctccatgggccagtatagttgacatataaaattaaccatcacactctagtacatttatcaaatctaagcaattaatatggaaccaatactatgaacaaactacagactttctttggaggctgatcattgttttttcattacaacagccttacgcagaccaaatgacctcagtgttagataccagagttgagactattggatcagtactaccaaaaccaagcaagatagccagacgacatgagcagagaggtaggaagaacactgggccagcagactacttgaattctaatcctggctttgctactgaaaggccctgagtcctagataagctaaaaaaaaaaaaaaaagtcccttcaagctctaaaagtctatagaaatttaagagggaaagtaaaatatgtatgtgcatgcaagtgcacgtacgcacgcacgcacacacacacacacacacacacaccacacacacacacacaatgtggtcctgcttctctgaggtctctcctctacccagtgcagtgcggcaacgtgggataagattattatcactcaggccctcagatctcagtgctgataagttcagctaagcctaggccctcctccaactgcagctaaccaccgtctcagcccaccttgaacctccactgaactcaccattctgatctcccagcaagacgtggccctcttctctgatctatctctcttctctgatgcctggccttcctacctcctttagggttggtggcttctcattctttctgctggtttttatgacttggtcattggcccggggagtcctgggtgctagattgagatagccctctgtaggatatggtccctgccctgcatccagcttcaaaatgtttatcatatcaccacttgtattttaggaatatgtgcctgcaatgaaagtcctccctttcttgcacaaggtggagcactgatttgctgctcatgtgcatgtgtgcacacacacactcaacctgaaaggaacggatcgtgagggcttccctgagcaggtgtcctttctgcatataaggaagctagccagaaataagtggtgtgacatttagggaacatttctagatgactttcagatgaggaagattgaaacaataagaggccaagttcagcccaataaaagcaaggacttcagggaacaccagtcagccttagcccagaggcagcaatggcagaagagtgtgcagctgatgcacatgacctataattgccaaatgggcagtgataacttaaagcctttatattcataactctcctctttgtggtcccatttcacatcctcttctggatggttgtacactacagaaatgtcagcacatttccactgagggggtgatggcagaattagaagttattacgtgtttgagtttcttaaccatattaaatctgcacctactatgtaccaggtcttgttgccagtagttatagaccggggataaaaagatgaataaggcatgattctaaacatcaaggagctcatagactgaagggaaggggcaaatggaaaaaccatgtagtaaattgtgtataaatgctgggctctaggggtgaaggggaatgagtgaagaaaccagcactcctggcacacctgtgagtataaagatgtgaggttagtgcccacactttcagctcaggctcagagtaaagagacacagatactcattcctactgctagcacctttctttcttccctaacctgtaagactggaccccaactagcctgcttacataagtatctacaattcaacctgtaatctaaaaaagccagattcagaggttctaaaattagatattggtaatggttacacaactctgtaaatttacccaagctccttaaaaatgtacatttaaaatgggtgactgttattgtatgtacattatatctccaaaaaaagctcttaaaataaggcagattcatgttctggatgcatgtaggattgtgcagtactgcagatcaaaatcatcacggcttccctaatttccccaacataaaatccctatctttggcctgacattcaaaacactgcaagaagtaagcctcaactctgggcagtgtcttgtgccttaaatgtgctggtctcctgcatggccagcatgttccattccattgcaacgcattctgtttctttccattctatctttttccatattatcccatcccacaagattttgtttgcctctttgtttgttttaagaacttactttagcaatgcatagctctatgatgagtactaaaaatatagagatgaagaaaacaaagttctgccctccaagagttcacaggtgcacttgttcattgtgaagacggatatagaaaccgacaattacaacaataatagccaacattaatgtagtgcttaccatgtgccaggtactgttctcggtgcttttataaatatgagctcgtctcatttttataactaccttatggggaagtactattattatctccattttacaaaaaagagaactaaagcagaaaatgattaagcaaaatgcccagcgtcttaatatgagtaggtagcagagctcaaatttaaatctggggatcctgcttcctgaattcatgctcttaacctccatgtgatggagagatctacacaaatcagaggtagaaatatttcccaaggaggtgacatctcagctagttttgagagaggagatgatgagaagccatgtgccacacagacatgggagagaagatcaattaaaagcagatgcaggccaggcacggtggctcatgcctgtaatcccagcactttgggaggccgaggcaggtggattacctgaggtcaaaagtttgagaccagcctggccaacatggggaaatcctgcctctactaaaaatacaaaaattggctgggcatggtggctgcatgcctgtaatcccagctacttgggaggctgaggcaggagaatttcttgaacccaggggacggatgctgcagtgagtcgagatcatgccactgcactccagcctgggcgacagagtaagactctgtctcaaaaaaaaaaaaaaaaaaaaaagcagatgcaaagatatgaatgtacatagtagggtatgtttgggaagccataaacaatttaatgtggctgaaatgcaaaggatagggggcaatgctggttggatatgaggcttgagctgttatgaggaactggattacatcagattgaggtactgtatcagttaggatgtgtttggcctaaaagaagcagaaaagcatgaccaaaactggcttagaccataaagatatgaattgttgcttatatcagaaagtccagagatagtaaggatttcagagtcggtcaagtcatcagctcaactgtgtcatcaagatctatcctttccatctatccactctggcatgttcagcggtggtttatatctcaaaatgactccgttcaaggtctcaagaaggcaaaatattttcaagattcctagccagatgtggcaaagttcaaaatcagtgagcaactataacagtgtatccttcttaagagaaaggtgaacttttccagaagacctcctcctgtcccactggccaggactgaggatcacgtatcaactctcacaaatcactgggaaggaaaatccctatattggtttagctcttagaaagggatggggctcacctttccctgagtcacacatgcaaatggtaaacatttgcaccaaattcatgttctgtgagtaatgaaatggggactgaatgtcaggcagccagtgagaataaaactcagccttttaacctaaaggctatgaaggtagagggtagggaagggcaggataccaaagttaagacaagtccaaactgaggctgagaagcaatcttttattcatacattcattgccttttagcactctagcctacagtcacatttcttcttttcttcctttccttcctctttcattctctttatgtttctccctttctccctcccttctgccctccctcccttccttccttccactttccttctattaaacacaagtttatcaagtcccacatggtttattatttggccaatatttttcttagtgctgctggaatcacagttatgaacaacacacatagagttctggatgtcccgtgttttgtgtatcaaggagtctttgtttcccttcaacttaccccatcccacctgtattagtctgttttcacactgcaataaagaactatatgagactgggtaatttatgaagaaaagaaatttaactgactcactgttccacagaattaacagagagcataactgggaggccttaggaaacttacaatcattgcaaaaggcaaaggggaagcaaggtcctccttcgcatggtggtaggagagagagagagcacgtgtgtgcaaaggaggaagtgccacacttacaaataatcagatctcttgagaactcacttactatcatgagaacagtaagacagaagtacacactcatgattcagtcaccttccaccaggtccctccctgacacttggggattacaatttgagatgagatttgggtgaggacacagagccaaaccatatcaacacctcttcctttagaaagccttttatgaacatcccagtccccagtgatctctcccttctatcagagtttctactgtccctgaggctccccactaattcttatggagcctagtgtgaaaaaatgcagagacatcctgtggaagattctgtggacatcaaaagcatcctggaacaagggtatgcatgtttattcccccacccccaacttaaactcccctctccttctttcactgtctttttaaattctctgataacgattattggttttctgtagccaaagggcaaaattaataaattccttagctgtacaactttctcgaaatctaataatgatcactgagtgttagagctgagataaagaatgaggaccataaaatagaaacagggaaggagaaaaatccaatgagcatgctggtgtgtgaggggttgaaggggtatcaagcctgtctactccgggagtgtttttcgttaaggtcaggaatttgagcctttaagaaaaagaggaaggtctaatcttgggggcttgaggtgggaaggatgcagggcaggaaaagggtggggaggatgagagtggtaagtgctccaggatctctgtagaccaaaggattaatgtgccacctttatcttttaaggcttttccccatgccacccccaacctccataatgggaattgggactagaggattcaactagcctgagtggccacaagtacacatttttgtcaaaaaaaaaaaaaaacaacccagattgtctttaaatttctaggtgggaaaaagcaggacagagttctccaatgtgtattaagccaaagcaggttataaggagaggagaggaatgttgccaggagatatagactaacccttgatatttcttcaagggacattctacctgatgtgtattttggaaggcagtggggacttgaaaatggttttagaatctgacagttccttattttattccctgatccatcacctgttggacgtggggcatttggaagtcactcaacttctaagaaacttagtttcttactgagtgaaatgggattcacgttttctgttcattctgcctctgtggtctgttttcaagataatgaatgtgaacgtctcacagagacatctgagttaggctgatgaggttgttatttcttctgggaagatgctttttgcttcccaaagggattgcattgccaatctcactgagtaatttatgtgtaaacaactttgattttccatctcaatgactttctttttctattctctgtttcagcatatcccagatctgtatactccctcctaaaagcaagggggaataaaagttacatgcatctttttcttactcatgaggatatgcagaaggagatttctttggtccaaatttagctagcagacacacagactcattctcaaagcataaaatttggattcaggcagtatttttatagtcctggtcagaccaaggaatatttttccatgaaccattggagagtaagttgccaaccagatgccccattaatccaaacactttagtgctattttctaccaacaaaacagtctcatagataataacaatatagccatcaaaatcaggaaattaacactgattcatcactactgtgggatcctcaggttccattcaagttttgctgaatgtcctaataatgtcctttagggaaaactattcaggtcagaaccatgcgttgttttaataggtaatgtcttttagtctttaaattcagaatgtgctctcagtttttccatgtctttcataatcttgaagcttttgaccagcaacccttttcaatttgggtttatctgatgtttcttcataattaggttcaggacttacgtcttcagatggaatatcacataagtcatgattctttgatagggcattctatcaagtggtccatgattttgatttgcccatgagggtgatactcactttgttcattcaattaagatgttgtctgccagtcttccctactgtaaagtaactctttattcctttgtaattgtgaagtcctttgtggggaggtactttgaaattatgtaaatatctctttcctcatcaaacattaaatgtattcatttattagtgcatatcagtatcaaatggtggtttcttgtttactgactgggttatactatattaatataattatttattttgatgctcaacttgtaccaaatttgaccagtggcagtgtccccaagctaactcctaggtctttgaacatgtttccatacttctgacttgctttctggaacaacaagatattactggtataactttaattttccttgttgtagctttggagtcagccatttttcccaggagcactgattgtttttagtagaagtggtacttagaggccaagatctggatactacatatgctcattgctattgggtaatggagggttggggtaaggagggttgctgtccttgagccctttcagtagatagagtttgacttatatgtgtgagtgtgtgtgtgtgtgtgtgtgtgtgtgtgtgtaagagacagaaaaacagagacagagagagagagagaggagagaaataatttggtgtttttttttttttttttttttttttgagaaggagtctcactctgtcacccaggctggagtgcaatggctcaatatgggctcactgcaacctccacctcctggtttgagccattctcctgcctcagcctcccgagtagctgggattacatgcacacgccaccaccattggctaattttttatttttagtagagactgggtttcaccatgttggtcaggctgctctcgaactctggacctggtgatctgcccacctcggcctcccaaagtgctgagattacaggcatgagccaccatgcctggcttctttctctttttcaaaacagtaataagactagtacttctcaaaatatatcccggcaaactcttaatatacactctgtaaataaaagagatccaaggtcaaccaagtctggcagataccagacttctctgaggtttgaaaatgctcctgagcttggtggccacccaaagagctctagtatgtagcacctgtttatgatatgtcagtcccagtgctagaatgatttgttgcttctaagtgatataaactgatatatttttaaaaaatcgtacttgaactctccacaatatatttatcatcactgtatgaaaatatactagagaagtactgacctctctctctcttgccttttctttgttaaatgatgaaatctccttctcttctggggcggaagtaaagaggatgggctgagactgtatcagaactagtgtaagtggaagagactgggtgaagttgatgtgaaggccctggttctgcctgattgaatctttgtgggttggaatggcttgagactatgattgtgacttttaggggtacaaggtcaaattgtgaccaattctagaatttaatgtccaagtaggccagcctaggaaaaacaataatgaagcctacatttgtagcttcttggtgaatacactaagggctggttccaggggttatagagcctttattgctcagtggttgaagcaacaatctttggaatcagttggatttgagtttgaaactttctttgccctgtgagaaggctacgtgactttaagtgttaatataataattgtacctatctcataatgcgtttgtgaggattaaataaggcaactgtatgaaacacacttagaccactgtctagcatatggaaaatgttcaataaacagcaaagtttttcttttttttttttcttattttggtggtgattgttatttcagtatcagttatgagtttgaatgttctcttacagaggtctatcaaagaatatgcaaggaagccaggaatgaaagagatagctctagaagaggccaagctttctcaatcttgccagcattggtattttgggtaaaataattctttgttgtattgtttgttctgtgccttgtaggatgtttagcagcatccatagcctctaccaactggatgccagtagtaccctcccaggcaaggcaaccaacattgtttccagacattgctaaatgtcccttggggtggaggtgggaaaaattgttccaggttaagaaccattgtgataaaggaagtaattttccagtgagctgagaagtgggtagaaaatgaaggaacagaaatgacaaaaagaaagtagtcagttaataaatttgctgctgagggagggagggagagagagatatatattaatggataactagaggagaagattaagaggattattgttattgcaaattattattcatttttaataaaagatatggttggatatgtttaaatactgaaagaacatagcaaatactgaaggagaagttaaagtttgtcacgggaagttacagtttgtcatgggaagttacagttttcctttggcaagcttcccttccaccttattctggtaggaacaggaaacaccctccagccccccttctcttttcctttcatgtctagaattacctctttctcactccataaggctatagggaaaattaggttactaatatgtaagtaccctccctcctggccatagtacatgccagatctggccagtcatagcacctgattcccctttgcagtaagtgtccttggctgggacaaaacaaatccttccttggaattttatacaacatatggaggaagatagattctttctgtttcctttatgttaaagatgtaagaatgtgtctctacagctcctggtgcccatgccccatacctatggaagacacagaaacaatgtggtcaagacagagatgggaactgagataagacagaaagagatagagagaactaggccatatgtgatggctcacgcctgtagccccagcactttgggaggctgaggtgggtggatcacctgaggtctggagtttgagaccaccctgaccaacatggagaaaccctgtctctactaaaaatacaaaattagcttggcatggtggcgcacgcctgtaatcccagctacttgggaggctgaggcaggagaacagcttgaacctgggaggcagaggttgcagtgagccaagatcacgccactgcactccagcctgggcaacaagagtgaaactctgtctcaaaaaaaaaaaaaaaaaaaaaaaaaaaaaagatctgtggttgtagatactgccatgtatgagcccatctctcacacagcatcatcaccaatcatgtggaacagttggttcccatttatagttaagtcagttaggtttggttttggcatagactgtgaatagagtctacaaagataaaggagagggaaggtatgatcagtagaacaaggtccttcaataaactgaagtgcatgagatcagggtcaggcagagagatttcccttagataggaagcaagccacactctagagatgagtaggagagggtggtattggtatttggtggcagaagctatgggaggcaccatggttaagatcagtaggggatctgtaagcatgcaatcaccagcaagttatctatgatctcacttttctctcttccactcaaggtaacattccccaaacacaagtgggagatgttattttacttctaaggtcatatccattgcattttaaaaaatccctccaaaagacaaaatattttgaaacttgagtaattagactattattagcactacatttctgacaacttacctaaccccatagtttcaaatactaaaaatcagagtaacttgagtaatgtgactatttttgttgttacatttcttgggacttacccaataactcatgtggtcaaagcctgtgggttgtgccactatagctgagagcaactgtattgactaaaatcacaataatatgtaagcttttccattacttgattataactgcattactgtatttgtaactgccttttagtttattcttaatgctagtgagcacttgacatgatttgagagttgcagaaaatagcccaaccaccaccacgactttatgaatagtaatgcatggggtatgtctgactacttactctagacctaccatagacatgactaatcaattctggcattcattcctattgggctcgcatgcagccacagaatccttctcggccttatgctccagagagtataaggctggcctcaaagatgcaatgcatttgctattgttgattggcttagaagctcttggggttcattcctgttcatttcctggtgaagaagaaatggcctccaggatctggcaagaataagggccctggagcagccttgagcatctggctctcaatttccgcattctttctctccctttaagaagaggtgagatgtgatgagaggcacaggctgtgaggcctcaggcttttatctctggcaatgacatgggcagcgtgacatgcagggtaatgaattgccgtctttgcagaaatgaataagttgtggtcagtgatgaaatgatcaatttgctccatcatgttaagctgcccattcatcatccacacctgctgtcaggagcccagggccgctgatattggcctcaagcctcttcctcagctagccgagcaatcgccgttggagctgcctccaagctcaaggctgcctttgattacagcctttgaggaggggcccaattacttactgctcagccaccggtgactctgaaaacaagggacatttgtgctgacctgggctgttgacatgtagcctaacaaaatgtgaaagaccctctgacagggatccaggtggcccgtcttattgtcccacagtgcgaccttgggccaggccatgtcatttctgttccttagcttctctattataaaaggaaggggtggaggagactcccagttctccatctccgacccaatagatctgcaaatgtctgctatggaaaggacagtttgtgattttaactcccccacccactgaggcaaataacagcatttattagctgagattgtttggcagcagtgaatcattctttggcttaactgaaaataaggtgtaattatcacattttactgataaggaaactgaggcctaacaaggttaagtggggtgcccaaagccacaaagagaggttgtgttatagttacaattgaatctgtatctgtttgacttctaaacccttgcttttcccactgcaaattgttttggctagagagcaggctattaagacattctagccaagccaatttcctgagagttctgcaggtaccaggtgttgctggagcccagcatctgctcagaggaaggcagagagacccagaggaacccagaatgagacactcatttttgcatcctcagtttccaagttaattttctagctcctggttaggacccgaattacagagaccaggcagctgtccaacaagaatgctgacaggtttcattgtcctctagggtagctgctgcctaaagaatatttgattttttgtttttttaacaacaacaaaaaagatgggttccctgtattgagcatctcctgagtgcaaagccctgcactatgtgctcaacacttgatccttgatggtttaaagcctcaacagtgtgatcaggttagttgctcacattcttggatagaaaaactgaaacttagagcagataagagacttgtccaaggtcatttagctcattagtggcagagctgtagctcaatctgtatccatcagtcatctgtccatcaagtccagtggagtagaaggggtcacacaatgggctcagagacagagaaccttgtgctagttcacacccttgacctgtccatgtatgtatggacatgtaagcttgggcgggttacacagggcttggttttcttatctttttttaagggcttggtgttatttttaaaatagcagagattctaataacagcagctacctgttattcaactcttattatgagctggcattcaggtgtttcattttatttcatttctgaaaacaatcccatgatatagcatcattatccctattatatatatccaacaactgagactagaaagggaatataacttactccaggccacaatgttagtgaatggcagagctaggattctctgacctcgaagtcaaagttctcagctacttagttatacaggagaaatgtttcttaatattgaatgtgcaactaaatcacctggggatcctgttaaaatgcagattctaatttagtttgtctagattggggcctgataatctacatttcaaataagcaagggatgccaatgctgctggtccaaggaccacactttgagcagcaatgccctggaatctagttaaagcttgacaaactttttctgcaaagagccagatggtaaatatttcaggcttactgggccataagtaactactattactttgttgcaactacttagctttgccattactgcaaggtatcagtcattgataatacgtaaacaaatggatgtaactatgttccaataaaactttatttattaaaaaaaaacaggtgatgggccaaattggctcatgggatatagttggcaaacatctgagagagtttccagatcatttagcttccatcagcctcattgtcttttcacacccaccactctgaatagtctaatgcaatggctctcaaagtatggtccattgatcagtagcatgagcatcccttaggaacttgttagacattcaaatctgtaggccccaacccagacctactgaaccagaaaacctggaggtgagcccagcaatctgtagtttaaaaagccctccaagtaatggttatatgtgccaaagtataagaactgagaaagaattgacatctctgaaatgtaggcaagacctcgtgccttccacttttggcagaatgagaaggcacaagatgacagggatgaggactcgaagtctggtgtcagatagagctctattgaaatattggctttttctctgattagctttgtgaccttggccaggtggctgaggatctgggaacaaaccacagcttcttcctttgcaacaacataagaatataaagtgtttatgaaggctgaggagtcaatgaaatgagttgatgcccacaaaggatttggctcagtccttggttcataaaaagtcctcatgaaatggaaaccattgtcctcattatgatgaagagaagtcctctaaatagtcccagatggactggtatgaactgtcaaatggaggcaactgggggcttttgaatttgagagcagaaatagtaaatgagaccaaatatgttgtgactaaaaatattgcatagctattggcttagctgtttaaagggactaagttaagagctagccgatcctgttcacccttctgggcactctgtagtgaatgcttgtcagttattatagtaaaccttgatttgtatcttctgagcagggctctggcccagaagatgcactgtgtgcttgaggccctgctagaagtggaaaaattaccagctttggatccatgtaggcaaagatttgaacctcctgctgctctagcatctgactgtgtggtcgtagcaagttgtttcacctttctgggctttattttctcttctataaaatggggccagtgttaaaaacctcattgggttgttgtgagaattacaaatgttgtcatttattttttttcagtgtactgtgtaccatgcactttctgtggatataatgagcaagagaaataagccatctctgcatgcaggagtttcagcttaactggaaaactaaacaagaaactacagtcaacatgctatcatggggaaggacaggagtctctttccggagaggtttgtccagaatttcccaacattggctgtacagcagaacgaactgagagctttaaaaaatgccactgcctttagtaccactgcagaccaactaatcagaactcttttttctttttcttttcttttttttttttttttttgagatggagtttcactcttgttgcccaggctggagtgcaatggcgcgatgttggctcaccgcaacctctgcctcctgggttcaagtgattctcctccctcagcctcccaagtagctgggattacaggcatgtgccaccacgtctggctaattttgtatttttttttagtagagatggggtttctccattttagtcatgctggtctctaactcccgacctcaggtgatccacctgcctcggcctcccaaagggctgggattacaggcatgagacactgcgcccagccaactattcagaactcttggggcaggccttttttcatatatattatatataatatatatgaaatatgtatattaactttttatttaacataatatcaaacttacagaacagttgtaaaattaaatataaaatattgccacttctttcagcattgtactggaggttttagtcatggaaattaggcaagaaaaataaacaaaagacattccgattgaaaaagcaataaaatgatctccattcattcatgacataatttggcatctacaaaaccccaaggaacatacatacatacatacacacacaattagaattaataaataacttcggcaaggttgcacagtatggggtcaacgtataaaagtcgattgtatttctctacactagcaatgagcaaacaaaaaataaaattggaaaaccaatttcatttactgtagcaccaaaaagaatgaaatacttagatttagaaatacacttaacaaaataagtgtaagacttctacattaagaactacaaaacaatgttgaaagaaattaagatctaaatagaaagacatcctatgttcttgggttgaaagatttaatattgttaacatggtaacaatccccacaaggatgtactgattcaatgcagtccctatcagattcccagttaattttttttttttttttgcagaaattgagaagctcattccaaaattcatatgaaaatacaaggaacccagatagtcaaataatcttgaaagttgcagtactcgcatgtcccaatttttcttctattttttccctgctactttttctcagtctctctttctctctacgaatacatgtacatatgcgtgtgtatgtttttatatacacatgcatacatacacatacatacacacacttttttctttttttgaactgggaataaggtaaagaaagacaatgctttttgttttcttaaatactttgggtcacattgcttcaaaactaagatattttatttataactctaatataattactgacatcaggaggttgctattaagatagtactattacctaatctatacatttcttcaagtgttccactaatgtttttacagcaagagaaagtcccagcccatgtgttgcactcagttgtcatggtctcttgggatctttgaatttggacagctttcagcctgctttgcttttataagcttgatgttcccaaggatataggtcagttattttgtacggtgcctctcaatctgggtctgtttcatgtttcctcatgattagattcagattatgtttttgtttttgtttttgagacggagtctcgctctgttgctctgtcaccaggctagagtgcagtggtgtgatttcggctcactgcaacctccgcctcccaggttgaagcgattctcctgtctcagcctcctgagtagctaggactacaggcacatgccaccacatccagctcatttttgtatttttcactgagacggggtttcaccatgttggccaggatggtctcgatctcctgacctcgtgatccacctgccttggcctcccaaaatactgggattgcaggtgtgagccaccccgcctggcctagattcagattatgtatttttgacaagaacaccacagacatgatgttgtggctttctcagtgcatatcaggaagcatgtgatgttgatttgtgatgttaactttggttaaggtggcattggcgaggtttctccactgtaaggttattatttttactttgtaattagtaggctacttctagggagatactttgaggctatgtgaatactctgctactcttcaaattttctactagaattgagcatgcctctgtaatttttaagagctcattgggttgtacgaatgtcaccatgtttgagagccactcacttaaactaaagagccaacactggccgggcgtggtggctcacgcctgtaatctcagcactttgagaggccgaggtgggcagatcacaaggtcaggagattgagaccatcctggctaacaaggtgaaaccccgtctctactaaaaatagaaaaattagccgggcgtggcggcgggtgcctgtagtcccagctactcaggaagctgaggcagaagaatggcatgaacccgggaggtggagcttgcagtgagccgagaccgcaccactgcactccagcctgggcgacaaagctggactccgtctcaaaaacaaacaaacaaaaaaaagagccgacatctggcctcctggaagaagagatgtttaaactgaggccaaaaggatgagtaggaatagccctagtcactggaaattggtgggtatggcactgggagtagatgttctaggatcataatagtcccagagacatgcaaacatacaagatacctagaaataagccgggtctagctggccagcagagagtacgatataggatgcagacagcaggtgcaagcagggggcattcagtgagtttggacttattacaaaggcaaggaaacactatgaaatgggttcaaccaaggaaatgatataacaatttttgtgctgaaaaaactattccctgactgccatgtggggcctcaatttgagggtggcaagagtgaaggcaggaagtgcagtgaggaggtgagaaggtgataagtgcctggagagaggaaatgacaaccgactacggcagtgaagatggggatcggcagatatacagcagcactgagacacagaagcactgtgtggagagggtgagtgtgaccactgggagatggcagaacatgacgacaaaggagaaagggcttctacaatggatgtgtgagatcagataaggcttcctggaggaggtggtgtgtgccaagccctaatggatgagtaaaacgtagccagataaagtggcaggtgttgcctgtgttctaggcagaaggacaagaggtatgaggacctaaaagcactcaagaaggctgaaacctccagaatggagcacgtggatgtgactggagagagaagcagggctgagtcctcaagggctatgagtgtcacactgagaagtgtgggctttatcctcatagcaacagcaagcggagcaatggaagggtctaaagcaagtttgcggtttagatgaatccactccagtggctcgtggaggatgacctgaaaggcaggggttagggaggcaggaagaacatctaaggagcctgtttgctaaaggtatagaagaaatagctgccgggggtccacacatgcagacgctcaacactggaagttgtcaccataactcccagctcagaaaggacagccaggcagatccattgcaagctttaattggggtcttttctgtaaaccttcggagagcaggtcaaaagatgaagaaaacaccttcccatgcagaagacagaaaggaaaacaacctgttggctggggatggggagaagagagaaaaagcaagggtctcgctccagtgcagaatgaagacaaatgggcagcgagttccggagaatacatcctttctccagaacacttgcctctccatcagggccacgcaaagccctgtcagtcgcgagcagagcttttgtgtgcgtgccggctgcgctcccgttgccatggcgatggggccataagtcatgtctgctggtgctgcacagagccgctgtgatttatgcctgtctcgctgggattgtaaacttttttttaatgttcaaaatccgtcacagccagggagggcagggtgtctctggctcactttggaggagaggaggtgttgtcagaccttgcctgactctctgccagtgatgctcctccgagccctgcagctggggtcgctggaccatctaagccaggctctgcagaactcccttctgactccagccaaagggtttcaaaaacctgaggttgatgctcattcctgaggccaggctactacctcaggagtatcctgtattcaattctttgttttgcctccccaggcttagactatgcatgccagctttttatgctttaatttggcttaataacctgcactatatcccagcctctttacaactggatttctagaaggtgcaatggaaagaatgtgggtttgaaatcataccttctaggcctgatttttttttttttcatccattcaataggactaatataccttcatctaaggcatgtcttctcaactttagccttttgctattgggggttggatagttctttattttagccctgggcattgtagggtgtttagcaatatccctgacttctatctactagataccaatagcaccctcccagttgtaaccccccagaaatgtttccagcgattgccaaatgtcttctgggggacaaaatccccctctttaaaatccagtttagagatgaaggaagtgaagattttcctcctgacctatactattctcagcttacacaggaaaccaaaatttcctcccaaagaccaggctgatcattccttctagatgccatgtttacctgactggaccagacacctgcacagctgactcagcccccagaacctgtgaagtccagtgtgtgaatccagccagatccatgtcatgaatctccccaggctgccccatttcaatacagttaactcagtccggtcacacctaggaggagactgcagggctgaaagatgctgtaagaggaggagagaagaggtgtattgtggagccatactgtctgttccagggactctgcaactagagtgcctttaaggtgtgtggcataatttgctagaactggcagggatggccatgcacccttcccccaaaaccattcttttttctcttatttcttccccccacccagccccccaccattttttattttggtaaaatacacacaacataaaatttactatcttaatcacttttaagagtataatttagtggtattagtgtattcatattggtgtgccatcatcaccaccatctatctccagaagtcttctcatcttgcaaaatgaaattctatacccatcaaacaataactctccattctcccctcccccaactctccgcaaccactattctactttctgtttctatgattttggctactctaagtacctcatataagtggaatcatacagtgtttgtccttttgtgcctggcttatttcccttagcatagtgtcctcaagattcatctatgttgtagcatatgtcagaatgtccttcctttttagggctgaataatattccattagataaactgttgacagatagttgagttgcttccatgtttagctattgtgaaaaacactgctatcagtctcatattctttttggaagcatctttgagtctcactccaatgactcaatcatcatgtacttaatgaacacttattggaggcaaaaccttaggaagggcaagtagagtatgcagaaaacaagagtcacaataatttctgaaaaggcatgagtttaaaaatatcctaatgaaggattcctacaccagatcaaaatctgggctaaataattgtaatataatgacaacaacggtagccaatctatttacgctaaatgcatcatgcatcaattcacttgattctcaacagcatttgcacaaggtagctacagttatttctacattgcaaatatggagaatgaggcagtgggatatgttaacttgtccactgttacccgcatagtgaatggcagagctaggatttgaggcagagcatttagcaccatagcctgtaccactgatgggatgcattaggctaaagggtttcaactggcagggttgcttcttcttcactactctgtctcacttacttttcttcctctgttgattctaggaaatgttatagttctactcacctgggacttgttctctttctggaatatcccagcatgggcatcctatccacacactgcctccccagtgaggaccctatgtcttctgcagagtcagggaaattaaacagggagctcagaggttggccagcttgactaagccaacaggagagagaccagttccctctgcccactcccaaaatatgtgtgtgtgcttcaaaagatgccccataggaaccaaatccctcattttctgatgtttggtttaacttgtgtagcctctaagccatgatggactcatctggtattacttgatgtcttcaggaatgctggtcttgaacttgctcctacttgagtagtgttggagagattgtagtatatagacttcatttcttaaagatttatgacatttgttcacatattaacatccctgggaaaactgccagcaaggaaatcaatgtagcaacttcatttataatagggtttctcaaaccttttaaattatggaatcctcctttttaatttcgttgcatctactaaccccaaagtactagtgttatttggaaccgcgagataatgtgtgttgtcataatataatacaataggcactgggatgcaagaaattttgataggactgttttgatggtagagtgtttataggtaaggggattgaatgatactttgagatagcgtaaaggtgtttgttaagcaatttagtagtaatatcaaaacatcttcgtgaacatacaagcagagccacataaaattaatgtcattgcaattttctatatcctctctctgagctatttactgtgcttagaactgggaatacaatgatgttaagattcgatccatgaactccaggaacacatagactaccaggtgagggcagaaagggatactaaactacaattgactccaatgcaatataaggcaatgccctgacccttacatctggaaaaaatatttttgcagcatgaacatagcaatgaggtgcctatgattctggagggcacattctcaaaaggatgctcagaggaagtgatgcttctgtaaggctgggatggataaggagtagtgtgctaggtacactggggactgtgagttttgggctattttaggcagagggagagcactggcaaaggcaaggaaaatggaaagtgtacagcattttgaggaaatagcaattgaggacatggtgggagatgagatcagagggtattatggccagattgtgaagtgctactgaatgctggctgaaacagtatgaatttttattttgaggcagttgaaggatggggagggctctaaatggttttaagcaggaaacagccatggcccaattggtacagcggttggattggggatgtgcacagagtgtggtggggactgaaagcagtgagactacgtatgagggcctgagccagaaagtgtccacgacgatagagaggcatgaccatttttgaggatattttgaaggtaggatgaaagaacttggggctttcctccatttgctcctccaagctcactctcagcttattcttctcttcccttgtgctcaggaggctgactttgatggatggactcgatgggcttttgtagttggcttctcactgggttcagccaatggcagcaccagcaggaggtttggtgagaagtggttgggtgcagttgggacatttattttcctggctcttttgcggcagagtcaccatgaactgtgtgtatcccttgactaaaggcctcagctccatggaattccctctccatgtttttgtaacttcaccctcaccttgacccagacactagccacagggcactgcagatctcttgttgcttttctggaactttccctcaattttgtgcatagtccccttttaaatctccccaagcttgagcatgccacctgtttcttgctgggatcctctttgatattagtcttcttgtttggtgagaggcaaaggagttgaacctaaggtacagatcaattaattattcattgacatatccaactcatctttctgactagactgccctggggtgtgtgtgtgtgtgtgtgtgtgtgtgtgtgtgtgtgtgtgcgcgcgcgcgcgtgtgtgttgactactgggtggttgatgcctattgggcagagtaagatacgctaagggaaacatggttctactcagctgcaacgagtgggccttaaaaggcagaatgatttctcatcttagcttatcttggtgatcactgtccctgagctgctgtctgcataattgaaagtatggcctgtttaggtgagacagagtgaggctttccaggaaacaacactgtgagaccgtggcaggcaacggagcaggaggcaatgagatgtctatcagcagaaggtagattccatcactcaggactgtccatgcaatggcagaggataaaaaatatgcgtcagaagatcccttctagtctgtgagtttataattgtttaaacaagcctttgaaactataggacacaattcaagggccctatgatgtgggtagtttgttcatagcttttaaatataagtgacaatgatagtgccagaccagagagtatctaggaagtacctacatggaggcctttactctgctacaagccagaaatttatttcaggaaatgtattggtaacaagataagattatccaaatatatcctctgagataacatagatggatggaaacttgtggataagacagttccatttcaaattcatcctcagtatctccattcacatgactgtcctttctctcatgtctcagcaaccaaagttatcgcttcattttgtaggggaacacaatgaggtcatgacataggaaatagggaggacttctaaataccatcaggttcagagatggcaaacacatgacccttctgttacaactcctcctccaacactgaaggtgggcaaatgagttcatcatgatgctttccccagcttagtctgtttgtagtctcagaaaccttcccagcataatatcttaggcagcccctaaccatgtatctgagttggcatgtaggctcggttaatggctgccgtctttgatttagtccaacctgttagatgaataaacttaaacattcagggagaattttgaagacatgggttggaatagatttgcagttcatggtcctctcaattatttccatggctgtatctgtacatggtgaccctgtcccctaatgataagccagggttggactcctaacatgtgacagacttctctaggatttttcgaaaggagactcagggaagagaactatttctccctggtggtaagagtcacaaagagcttggggagtcatgattatcacaacccctatcatgacaagatggggagtacagaaagaaagtggttgtacaatagaagagaatgaagccatcatggaatgatacagagaggaaaaacagaatcctaatattatctaactccctcaactttcctcattcctgtggctgagctgatctctttccctttccatgatgtcattccaatagagttgccattaagctaacttgaattgggcctctgtcccctgaatcccaaaccatcctgattcatacagagcagaaagggcttccatgcaggaagtgagggagaagccatggaatgatgaatgggtagatggatggggtcttgaggtcagaagtctatgttcaaattctaattcatccctttaccatctgtgcttcctaaggccttagaatgtcagcttcctcatctgtgaaatgggagataaaaatagcttcaacttcagaagatggctgtaaagatcacttacaggaagctgagcgggaggcctctgcccaaaatgctgcttatcactatctccagtttggggtcaggcttcaaacccaggtatactaacccccagcccagtatacatgcccaaaatcatactttcatgtgtctctctctttcatctaaagatctgtagacgtgtctcaacatcagaagtccccttttaaaagtgtttaacttctaatgcagatataacaactcatttctcagtttcactgtatctgcaaagctttctataattcaacatcaaatatttattattacatttattaaagttttaataatttagcatttcctgcatgtaagatagaagcttagctaactggttcccctttatccagcctgggtcacttcaatatttatattccaaagtctccatttcagtttcatttagcagaggctgtgtcttgagccctctatctgagctgacagttggtgcatgctacagtctccccagtggcaaagacttacagaaatttggtgctgaacaatgtttgaagagatttactgagcctgggcagaaactcatcctaatagacttcacttttattatgattgctaaggtaaaatggggaaaaatatatatgtctccaggctcactggctgaatgacaggtagtggggctggaaagagtggagggcatagagtacgtccacctgggaggaagtgtggtggccttttatagtaatgtttctcagacgggcctcattttctttaaaaaaaaaaaaaaggagggatgtggaggtaccacgaaaatgctaatgcccatattccatgaacctagctgtgagttacccacactctttccccttccccatttgatatttcaccttccacttgcataaagaacacacacacttaatagaccaaatgctcaacaaagaccaagatataaagtccaatgaacctattcctccatcttacagagaatgccccttcttcaacaacagccaacatttactgagcactcacaaaacatcctgagttgaaatcctgattcggccacatactacccatgtgacattgcatgaatgacttaacatctttgtgcctcagtttcctcatctgtaaataacaataactacatcactgagttgttgtgaggagtcaaaatgaaaacatgtagagcacttaagacattgacaccaagcaagtgtgatcaataaatgttagtcattagtattgatgactatggggctaaaagtttaagtgttatctcattccattctcaaaaaaacattcaaagatagagtgttagttatcattcagataggaaactgaggctcacaaagtttaccttacccaaggtcagctagtcagtggtggagctgggatttgagactaagcagtttggctccagtatccatgctattcacttcgcccaatacctcttctgtgtttcaagcaggtaagtgggttccctattgaagttctgtcaccctttgggaaaggaacatttgtgtgagtaataggtgagaaaaggaaaagtttagaggaagcatgatggacttgagagtctacctgaagaagccacccttctatcaacatccctactgaaaaggaaagcacacttctaggttgcctacaatgtgtgcacacatatgcacacataacacgcatgcactcattaatgaaagcttgtaagagagctgcaagggcaagaagtcagttttgctcacctccaacaggacagagatatcttgaatattaaatgatgtaagaccggtatcaagggccttccccccatactctgctgccgggatccttctcaagccaagtgcccccatgcaattcatcgagtgactggccccgactccagcctactccacgtgtcctgctgccccaaccctcccttctgccatcaatgctcctgccatcaatgcacaatgtgatccagagaaaggaggcacacatcccttctttataccgctctgaaccatgaactacatcttttaatcacggacacactgcatcacatggttgcttccttaactgtactacaattctacaattcctactgcttctaaaacttctcattcattgaatatcagttacatgtaatatgctgtactagtaaccctatacacattatgttatcctaataaccaccgtatgagaaaaacacacaaatctccaacttcctggttctgacattgaggctcgaagaggtgaacaaactttgctcaagttaattctacactctttcctactccttcttctctttctggtttttctacttctagagcctagcacaatgttcattacacagtgaagtacctggtgtgcatttgttgaggattgcacctgaagatgtatggcccatgtttccagaatgcactgtatctgactaggggtactgcctagtcccaagccagattccagtatctggagcagtcacacaggaacatctgttggggaccctggagcagtgaatgaatacactaccctaaagtgctccaagagtcattgctgactctgctagcccaggtggttaacagctgaaaaaagagagaaaagaggagagaaaagagcatgcatgttctctctgctgtccttctctcccttcatcaactgccatgcatcccttggcactacactgcagccaaactgacatggaagttcctcctggctgggtgtggtggctcacaactggaatcccaacactttggaaggccgaggtgggcagatcacttgaggtcaggagttcgaaaccagcctggccaagatggtgaaaccccgtctctactaaaattacaacaattagccaggtgtggtgttgtgtgcctgtaatctcagctactgtggagggtgaggcaggagaatagctcgagcttgggaggtggaggttgcagtgagctgagatggcaccactgcactccagcctggatgacagagtgagactctgtctcaaaaaaaaaaaaaaaaaagttcctccttaggcatgccacactttgccagttcaaggtcctgtgccttgcccatgaataaaacatctctgggtttttcttatccaacatctatttgctacctgtcctgctttttcactggggaactatcctacctgtgatctcaatccaggggttaaggtgctcctcattcaaccctggtttcaagggtaagttggtgacccaggtctgcctacttagaacactttgtctcttgagagattgatgtgggatattggcaaagatcccaaaataggccaaagagaggcaccatagcttagagatgaggaacatgaactcaagagtcagactctcagattccaaacctggttctattacttactggctgtgtgatcttgggcaaggtacataatcctctttgtgcctcagtttcctcatgcattaaatggagctaataatgagtaaagactaaatgaacttatttcagtaaagcacttggaacagtgccacctaaggatgtgtgattattgctgttcctcagtgacaggacttctgcataaaccattgggaaagggggcatctcattactctggcaacacttaattgtggttgtaagcctggagaggtcagtgagagtgtgcctgaaaaagaaaaacagaaaaacagagtgcaccagagaaacacagagatgagggacgaaaagaaacaggaatagtgagtcccaacatttgggagcatataaaccttactatgccaaaagccattggcactctggagttttcaagccctgatatcttttgttttctacttaagactaagtaggtgatccattccttgttttgctacctagtgcatttgtactcaaactttagtgagcattagaatcacctgaggacttcttaaaccagaattctgggcccacctccaaaatacctaatttagtaggtatattattacatagtttctgtggctgctgcaacaaatcaccacaaactggggcagcttcaaacaaccagaaatctgaaatcggtatccctgggccaaaatcaaggtgtcagcaaggtggtcctccctctggagcctctggggaacaatcttttctttgcctctttcagcttctggcggcagctggcattctgtggcttgtgattgcctcactccagtctctaattccatcttcaaattatgtctccactgtgcatgtcaaatctcactgtgcttctttcttataagggtactcattatggtgtttcagacctgtccagataattcagaataatcaacctatgacaagatgcggcataacatctgcaaagaccccttttccaaataacataatatttataggttctaggagttaagatctgatgatacctttggggatcattatcagtctacactagatatgagaatttacatttctaataagtttctaggtcatgcgaatgctactggtccagggaatacactttgaaaaccagtgagctagtgacttcctgctaacacttcaaaatttggcatagaagttttgagtcctttcttttaacctccaggtgggtttgaccacctctgactttgtgtcttttttctgccttgaactttccctctattcttcttcaactgtcaaaaagtatgacattttttgtttgcaattttgactcatttaaagcactgaaatctttgtcttatttttatatctctattacttagtttaaaatatggtaggtgttcagtaaattctcagtacttggaattgaaaggccaaaagaacaaggagacattcctaattctattcagaactaactcaatgtgaaaactatcaccaagtgagccatgccagcttgcactctgatatcccattattctttcagcgttgttcaggaattaacagtatttcaccatttcattttcgttgatttgagatcacagaaaaatgactgaggcgctccaaaagctgagctttgtgggtgattattattccaactataatagctattctcacatttatcttataagaacctgctccaggtgaaattgtgaagaaggcccagtatgcagtaataagtgttgtttgccatgcttctccctccacaagcatcttttattccatctctcaagttggtctcttgtttcatgctccttgctataccatgaaactcctgaaagcagaggtgggctgtatttatctctgtattcctgtggtatatggcatagtatctggtacacaggagggatccagctaagatttttcagaattaaaatatatctgtatgcaattcagctagagatttgctcttccacctttgtagctggcatcgttagtgtctcaaatgctaaaatctcattcccagcagcttcctgctaggataggctggagaatgggagctgtccaggggagagttttattttgcccttcaacccctcacacttgaaagccttacccctcaccttagattgcacaaagtcaaagcttagctacagtttttgaaaaattggcaatgttctctctcttgaaaatatttgcttaattccctcagtcggatacatcttctttcttttccaatcctttccagtcccctagggcactctatgtttaccacacatgtgactcttcattcattctgtaaccatgtccatgtacataaagccacagacctagcatactgaactagaatttatagactcatttaagtcttcctcaaagcccatgacaaagtggttaatatgaatcctcaacactgagcaactatcgattttcagttgcaccataggtcgtctttagcctttcagcgaaaacatgagaaaataatgaaaagataaagagaacaaaagccactatgttacaataatgagcatgataactaatgcttctaaagagttcaccaggtagcaaactcactgctttacatgtaatatgtcacttaatcttcatcactccatatatgatatgagatttttatttccattattctgaaggggaaaccacaactccagaaaaactcctgcagcaagcaagtgatggagttaagatttgcactcagccaatttgcttgaggtccatagcctatgccctcagacaataaactttatgtttaatcaaaatatagaatacatagagaaaagtgtgaagctcagtgaattttcacagagttaaaacactcatgtaaccaccacccataacaataaatcaaacattatcagcatcacataagcccacttgtagttccccatgtcaccaccctttccatcacccagaagtaatctctatcctttcttctaacatcataaattagtttactcattaatgaaactagttttttttgtttttatataaacatatgatattattttgtgtctggtttccaaaattctatatcatatttgttagattcatccaaggtgctatgtatggttactgtgttctttcatattcattattaatggcattccattgtgttattattccataatttatttatctactttttcgctgatgggtatttgtatttttttttctagctttctagcagtacaaatgagtgcttctattcgtatttttgtaagtcctacttgtggcacacatttacatatttctgttatacatatccttatgggtgaaactgatgagctatagaagatatatacctccaactttagtacataacactccacaggtttacatagtggtcatacttatttatattctcactataaaaatatgaaagccacagttgttccatatccttcctaacatttgttatcattagttgttttaaatttagctgccttggtaagtcacagcctgtacatttaactactaagttgttctgcctactgtagtgtgagttctcatacttgtccaagaatttatcacagattagaaatcaaagaatcaacttgcagtgcacgttcaagttttcctttccaatcctactgtaatgcttaccttccgtttccctttgactctgcttttccacgtagtctttcctctaatctctttgttgtgattccagggcagtattattggctatctataattatgatctattatttattaaatttccaacataccatctgactggaacttattaattctctaaatgcccatgatatgcttgcctgggcaatgtcatgtcaaacaaggtttattagtgcagcttggaaaactcaatctacatagtgcagattctctcaaatggtgatgattgcaatcttttatcccctattgcagatcagggattgaaatgtggcttcatctcttactagtgaaggcattacctctatgcctcaggtttgtttatttatttttgaatctgaaaaatgagcatcacctcatggagctgatgtaagaatgtaataatattagtgaagtattcggcacttacttagaaaatgatcgatgatatgaactattattattattattattattaccctctgtgaggaaggcactgttattatccccattttgcagacaaataaatgaaaacgtagagaattaaacttggccaccatgatcacacagttcacacttggtagagatggaattctaaagcagccctatccaactccagagtatgtgttaccatcagccagtctgagagagctgcatcatctgaatcttcattgaaatcatggatgcaatgtcaacaggacagaactatgaggaaagctagtcaagactttcttttcagctgatttcaaacgaggtaactgtgtctttttgagaatagtcttttaaaccagatggtccttgctttatctttaaaatatataatgcagagagaacttagcacatgctttactaaaatctcgtatacttcaattctatcaaaaatgaaaacaatggtaaatatcgatgaatcagtatgtgaatgtgtgtgtgaagctattttagttcctagtaatcactatttcatatcctaagtgccatctctttataaatctattctttttaaaacatcctcttttgggaaatgctaatagcctagaaaagcatgataagttcatccctcccagtgaaagctgacaaggtgagagtaaaaacatcttaaagtaagagagttgggttctaggagctttctgtcaagatgccatagaaatactgatagcattgtgatttagaatgacccaaaggcaactatggagctgttgaaaaacagtcactggtagttagggggtccatgatttaattctagttcatgagccaataagctgtgtacaaatcagttttagaagtaaaactactctattcttggtaacatcagaatttctagaatgcttcccctaatcaaattgggagaaataaatcctccactggaaagctccagaacagtgctaagatcagatctaagaccacagacttaattaaatcaataaacatttaatagatgtccaatatgtactaggagctggggattaaaaagctaaataagttattttccttgaccttgagaagtgcaccataatggggcagaatgatatgtaagcatctaattagtatgaagtagagtaagtctataatgaagttagctacaagctgcaggataatgtaaagtgaaatgtagtctccgtggttttataagttaagaacaaaagatttagcctggacttttttttttttttttttttgagatggagtctcactctgttccccaggctggagtgcagtggctcgatctcagctcactgcaacttccgcctcctgggttgaagagattctccagcctcatcctcccaagtagctgggattataggcgtgcaccatcacatcaggctaatttttgtatttttagtacagaccaagtttcaccatgttggccaggctggtctcgaactcctgacctcaggtgaaccacctgccttggcctcccaaagtgctgggattacaggcgtgagccaccacgcctggtctttagcctggacatttaaaattcataaattagcccaaagcacatcccatggactacaacagaaaacatcccattttctaaatttttgcctttgtgactctccaacatactgttaagtaaagataagatcattaatgatcccatgatgagctagataatgcatcagcctcttttatatttaatataaccaaaaaggaaagcaatagtgttgaaacgtaaggcattgagacacagtgatggaggtcacatctaagagtttaggagcatggcatatttgacagtgttcttcacatcaactaaacagcaagaacactccttaggggttcctgtggttctccaacagggggacttccaaggttttaagaagtacctatgcagagtactggagatgattccctacctgacatctgcagggtcttccgtgacgagcacatcggtcttgcagctggccagggggttgatggacagctccacaggcggaaccacaaagcttttgctgacaggaagccagaggccttggcccaagctgaaagtagacctgcaatgtaagagtttccattggggaactccctgggaagcagagagcaaacagaaaaaaggggcccctgttcccatcccttctagggcaatttcctacttctccatccatatccccagcattatttaaggaacaatgttggccaactttctccagacctggatgatcatttctcaaatctgttaaacatttagctcatgaattgctttgtgttgctaagttccttttcctgatttactagtggactctgtgaggatagggaccattgccgctctgattttccagcagtcctgacatacagcaggagttccataagcgactgctatgtcagcagggacagtctggcacaaaggttaagagcacggactttgaatcagtttgaactaaaatttgattcccagttctgccacttaatttgctgtatgtctttatctacatgttcattgaagttttacacaagattttgtggaggtggtgggaagaggttctatggttacagagtatttttaaaccactggacttaataatcagtaatgtctcctccagttcaagtatctgagtctataagtctagctgccagacaaatgggaattagattcccatagcaacctgcgccatgatggtacattagtgccagggagagttcttttgtactcagtgcagctcagaagtgcacaggctcaatagtctaaggatccatgaccacatcttcctatcagtcctttctccatttcccagaattatgccccaacaagaaagccaactcacctgagaatcttttcaggggcttgctcccctgtcaccagatcatagcccctctcaagtgtcgtgtagggccaaggtctatgggaagaaggagaggggagagaagatgacattagtcagaggcaggtagaattcacatgtggacactgctctagagtagctttacaaacaaccaaactctgcagaaataattattgggcaagactacttatattataaaagaatgtctccaatttacagaaggattcagcactttcataaagtatgcatgtccattcaggagtctgtttaaaaatgttcttcttttctttggcagtccacttaagaaagtgttcattgattactttgtttggacaggtgacttaaatgtcagcctttgttctctagaatattcaccaatcatgtacctttaatactaaaatgtgattccatgggaaagtaggattcacttcccattgggttttgcaggaacactactgttgcagagaaagagtcctctttgtggagatgcttggggcctctggtaacagaacagaggaggtaaaagtgggtcctgcactgtcctggacctgatgccctttgccactcacccttcactctgtccccagtcactgcgcacacacaggtgtctgtgaacagggtcaggggcatagccttcatgacagctgcactctcctgtaagtgaaaagaaaaaagattattgttaagtagagtctccccaaataggcttttctctggtttgcttgttttcctaagacataaagtgagctgcttagttttagaaaaggcacatggaaagagggtaatcttgtccatcaaccactgtggttaacagagtttattcctttgttcattcactcatttattccttcaacaaatcctggccacactcgtacaggtgctcagctcagcactggagatacagaggtcaaagttgcaacccagccgctaaaggagctcacaacttaagacagggaaacaggaagtgatcaggtggctacaaatggaggtcttcttttcaaatattaaaattatgataaaatgcatttactctagaggtataatcagaaaattgaattatctccatctgaatgaataggtcttcaccatccataaatcccaagttaaatgccgctatctccaagaaacctttgatttcccctttcagaaaaacctgtctgtagtctcctggttttattttgtgttgcttttcatttttaaattatttttcctctcctccccttccttctactgccatctcttctcttgtcctcttttctcctctccctctctcttgccattctttttcatttctttcccttccatccattcattcatgaatcaatccatccatccaaccatccattatttttttttctggccatgccttacgcttggttgcatgaatgcttgctagcattacacactgccttaagtatattctctcattggccaagttcatttcaagtggccagcatatgtccaatttcctagcatatcttcagagtccagaatcctagaagtgatttcagaatctctctgtcctactcccagctgttgtcatatctgctctactgtatacttaaggtatagaatttctttttctttttttttttttttttgagactgagagtctcactccatcacccagactggagtgcagtgacgtgatctcggctcactgcaacctccacctcccagcttcaagtgattctcccgtctcagcctcccgagtagctgggattacaggcatgcaccaccatgcccaggtaatttttgtatttttgatagagatggggttttgttatattgaccaggctggtctcaaactcctgaacccaagtgatctgcccacctcagcctcccaaagtgccgggattacacgtgtgagccaccacgcctggcctagaaatattttttgatttaatgagttactgcttttttctccaaggtttatttgtgagatgcttaaagatgctgtaccaaaaacagattctatttaaaaatgtgtttgggtaataccaccccattcctcaaagccagtgtagtgtgattctccatgagggtgatacatacacaattttcaccaacttatttttctttgggagccttgttggtggaatgactcacaggattataattctatggaacacctctagggaaatgctagtaggaaccgccctgactttgcttactgcctagaatagggtcagtgcttaacaatgtgagttgaatgaataattaactatctgttattgctctggtaaatttccaggctaatgatgttggcttgtcttctttctcatcttcttgtaatcacattatctcattatctctctctgtatctctctctgtatgtatctctctctctctctctctctcacgcacacacacacacacacacacacacacagagagataaacctgtcacccttggatcctacagtgattctgatagacaggacccaaaagttttcaaatcatgtccatggaaatgtattacttaacagagatttagggactatgcaaattttatattttaatttttcttaaaagttttattttttaaattgttaaaaatataaaaacaagaataaacactcagatatcacatgccagaatttaggatactgaagaaagtatcagttgccagataaacttattttatgcaggcttcagggaaaaaaaaaatctcctctcatctttgtttcatctaaaaagatactgaggatgagtcaagatgccaacaacctcatgctatttgcaactacatattttgggaatcaggattttctcaactttatacaactaaaacaaaatattgtagtaaatagaatactagggtaacacgggttctacaactatcacccttaattctggattttgaaatgtatgcattcatcaagtaaacttattgttatctctgatgaactgtaagtgttatatatttgaccttatatgaagcattctgagtgtttaaaaacactgtaacttgttttatagatgacactgctgcttaatctttgtattcccagcacccattgacaaatagcctgggcttcatgaacgctgcctgaacaaaaatggtagtaagacagagtatggagtgaagaatgggtcagagatagtattcaaaatattcagaatgaggttgttgaaagatacaaggagagacagaagacatgtccttttcctctcatctgcttacctgaaaaataaggagggcttgctcacaggtaggaatgctctctgtactccttccctgcaacatcatgcctggggtcttccaccaagaggaagtgctgtaagtagtgctacctaatgaactgattgttgccagaggtaagaggaatggaaggaaaaggctaagagccttgaatgtggatgtaaataatttaccaaagcgaggaggggcaggagtcactaaagaagtgttaaaatgcaacagtcccttcatgaaatattcaccactttaaacacgtctaatattaaagattaaaagtcctgggatttgtcctccagactcccaggactgatttatgatctgctacaagccacaggcctcatgattcataatgggagaggtaaaatggttacctctggcaaaggagcaggaagtcaggctggggtggatgaggaggggccaacaaggaggatccctcttgtttatggaaagggcaaaggctgaggtccctatctctcctgcagtgactctgcaggaaataccacagttcacttctttcctctttctctcatttttggaaatattggtgacattgagaaatttattcagaaaaagggtgctgctatgtttttctctcctccttgtgcacttaccaggcaagttttccctgactcagaatggatcattaattactgatgctcattatacaacaaatatatattttgcaattaagaggcattcaccctggagacccccatgaggcttcctggagaacggaaagtaggcagagggaaaagcccccgagtgctagcagcagatggacccggtcccatcctcttgttctctccctagttgtgtggccttagggaagtcgcctttttggtttcagctttcatttacagaatagggatgatagcaatgtccatctcctagagctgatgtaagaagtaattgaaatagtgaagaatgaagctagtggttgaggtgacaattagctgatggtcatactacccagaaactatgcacactacatgggtgcaatatatccatgtaacaaacctgcaaatgtaccccctatataaataaaagttgaattaaaaaaaaaaaagaaaagtgtttccttccctttaattccaagctggccactgggttctggtatatgtttacatttagacaaaactatcacccctaactccttacatattagacatgtagagacacaaattacctccttttggggccttagtttctccttctgtaaaatggaaggttggagtagatcactcatcacttctgagcaccaagactctgctgtttgcattgcctttccaaatccctaacctctgctttctggatactgtttgttttagtttcagctgcaatcattcttagcagcagcctgggtgtctctagcaagatctccatcaatgccataggtattggctttattgactcctgtttcctattttgctggctcagctaaatctccactatttgcaaccaggcatttccttcttgacagatgaaaagcctctgacagccagagctgagggtaattaacctcttccctgggtgactcctttcttcaactctgcttctgcacacccagagcagcaaggccatcaaatgacagctctctagggatgcatgtaaccatgctgactgtgaactcctgtatagggatagggaactccctatccctataactctagtaccttccttgctcaccactgcatctcagcacctcctgcattgcctggtacagagtagggattcagtaaataaatgctaaatagatgaagggatatatttcacaatagtgatgcctatgccaatggaataggacaataattttttacttgcctgttcccccactaagctgggaatttcttgattgcaaaaacattttcttaatcatcctgtattctaataattagtataatgcctgataaagggtaggcaactcaattattgaatgaatgaatgaatgagtgaattcatacatatatcatgattaccatgaatttaggctgagttcatttagaataatgatgactctgctgaggactggaagaaactttctacatccaagataggtatttgccaaggaaacaaagagtgcaaacacaagtgctgatgaaatgtcaaaaatagaattctattttacatcagagcagaaaagacccttaaagatcagctagttcaaactttcccagtttcattattcagaagaggaaactcaagctaagagagtaaaggagtttgtccaaatcactggcctagcctctgggccagccaggatggaaacccagggctcttggccaccacttcagtgtccttttgctgcattggtggtatcaatagttcaatgcatcctgaagtcttttgcatcaatttttctgtacatttttgacattaccaagttttctaaaaatgagagcattgacaaacaggtattatttaaacagtaaaatgaatttgaaatacccttaagtacattaaaaacatacatgtatatgttgttagtaatggagacctaaaaaaaagaatttactctcttcactatattggttctcataagggaattcaattggatggttttctatctggctatttaccagaactgtgttatcagcagtagatgagttgtgttggttttaaaagatttactcttcatgtctcctggctgccatttgttgaggtctttttctatgttatatgcattctcagtccagaaactcttgggtaaaaacaacaaaacaccttgatcatgaacaatctgtgttcatctcctgtgaggctcttccaaacaggacaatgctttcttgccaaccacataaggccagtaggctggtgaaatagttcagagtgtgggtgggccttgaaatcatcatgtactgcattcaaatcctggatctgcctgccacttcaaatttgcaagaacctgataaattgattcttctctccctgagcctgtttcctttacctataatggagctgacaccatatgcctgtgggaaggatcaagtgctgtacttgaaaaatcctcagcacagtctttggcacatttcttcttgctgagaacacaaaacagctgtttgggttcatataattattgttcttgggtaggaaaggcccatccagtatgttgttttagcagaaaggaaaggtgcttagaatgaaagatggtcaaaaatccaagatgtgccctttgcaaaacccaaaagaccacagtttctttatctgtaatttgggattttttttttaaattatcattattatttttttagagacagggtgttgctctgttgcccaagctggagttcagtggtgcaatcatggctcaccgcagccttgagcttttgggctcaagagatcctcttgccccagcctcccaagtagctaggactataggcacgtgccatcattcccagctaatttttaattttttttggtgaaatgagacctaactatgttgcagaggctgagatcttgttcaaattccagcagtttgaatgagataatccccgaagctgttcctgtgtttccagagctacgaagacatgttgcctgtgtccatggcagcccctgctgaaggaggtatgggcacggacaaggcataagccagaggccgctgcctcctccaccccagcagcacagaggagctcatggcttgcccatgagagtgcaaagcctccttcataagccatcctggctgtctgactcccctccccaaaccctgtcattctatgattccattttcacttgcttctaactcagtcatcacttatcatcaccggccagggatgctgcctgctgttcactttcttatttgctcttcttgtcactgtggtttgaaaagacatctctctgggccctcagagcaataaacatggatcccttccccatgttgactccaagtgagccaccttgggactcttcacctctgtagctctgtaactcaactcagggccaggcacgtagtgggaaaagtatgggttgggcataacattatgagagcctgctttgtgctaaaagtggtatgtgacatttgacatgtgtcattgcatgtcacagccatgactagtacaaggaggaaggtactgatgccctccttgtaaaataaggaaactgaagctaacactcgactagtcagttgccctaggtcatagggccaggtctccaaagctcatgcttgcttacaccaccacaaacatcacaacaataaacataaccacaaggacaataacaaggacagctgcctttgacaatgatcatgtgtgagacactgagggtcatttctctgtagtacttaattatgcattcgcttctttgcagtggttaattgtgggaagagtaaattttctttccttccctttgtcttcaggcttggcatatgacttgctttgatcaatgggatgatgagagccaggacttaaataatcaaagttggaaatatatttatgtggataggctttccctcttgtactcctgcctcttgccattagaaaaaacatctacaggctgtggctggtccatgaaggatgagagatgtgtggaatagatctggattcatcctcagcttagagccaagggcagctgagtcctggctagatcagtccacccagatgtgtgacaaaggagaaaaagatgcttacttatagttgtggacaataaaatgtgattgatatgcagcgttattttggcaaaagtttctgatgtactttaaacctagatgtctacatctctataagtaatggtaccagtttctttcctaattggaaacttcagaaaaacttctaatggggccctattttgtactctcagcatctgagtgatatctgaatcccactgattctaccgctttggttttatccagacccatttattcccatctctcttctctgccactggcctggttcaggccctcagcattgtccatgtgctatgaacctattttctgtgtccctacatctgatctgactgttggccagttatcttttcaaagaacagctgcacccatggccctccccaaaaactctcagtggttttcagttgccttcagggtagaagtcacatatcccagtcaaagcctttcattactggcccagccaatttttccaaccttatcaataactctgcctccctgtgacttttatgctccaattttttctgagtctattggtaagagcagggtcacttgagaccaacgttcagaccctttgaagcttctttcagcaggtctgccttggttctacccaggggtcccactcagagatcccactcaagcaaagcctgagccctggagagagacaaagtcaatgaaggagagactaaagtaagagggagaggagaaaagggaaaattaagtggcaaacaattattttgtaaaagaatgagataatttgggcactgttgagtataagtaatgtcatcaggggatacattttacagccctgaatcctctgcaaatcattctacctttctggacctcagccttcccatctgtaaaatgagtgggtagtacttggatctcccacttttccaaatcttgttaaaattccagcccttgattcttcctctaatatattctggtctggtttcttgaaatcagcatctctcttgtaattcaggaagcaggataagtttgggggcttgggggaacagagggttggtaggcaaagaaacatgattcgcgtgaaataacaagaggatataattagaagctttatgaaatgaggaagattctttataagtctactcagccaaatgtattgtgtgacctgaggtagttccctccctctctggggctcagtttctctatctgtacagtgaggaggctggtcttgacatctgagcaacttcacatgggtgtctctgatatccctttcttccttatactgctggtgtgagactttccaaccttgttcttcccaaagcactgagacaaatgtggactccgcattgtagctgccggccccttattgttattcatcagcacgcctctgagagcacaaagtaaaaataatcagaggctgaaaggttctggtggcacaggctggtgatcaggtctgataagagattagattccttaatcaacgctacatgggggctaattattgttggctcagctcatgtggacagtccatacggggtggtcaggctgctgagaggctgccagccaggccccatcagggcccctgctccaggttctcagccagggtaaccctttccactggccctattccctttctttctagcctcttccacctctgagtgcaccacagacatgattatatattattagtgtctaggagaaaagcatgtggcaaagagcttcccgcaaaatcatggctgattaagtatggagtggggtgaagaaatctcactaacagcctggaatggacacagagcatgtatttccaacaatccagaaggatctggcttcagctgatgaacacaggacgcttaacatggatgcacagagctgagcctgccggtgagaggctggcttctcctcaccctcactgcacgccagagccctgcaacctctaagcttctcagatgcaccaggaaggcatggagagcagagggacacagcctggtaaggggaaaggtgtcagcctggcaaccaaggccattggaggctgaatcctctgtggcctgcatcaatcactgcacctctgggcctcatcagaaaacgggcatcttaaacccaatttttaaaattgtcacaaggattgcagacaatatattaaaaacagttactgcatcgccagacgtgtaggcagcacttggtatgttgcagtgtcgttatcgtgattgctgccagcactgctgtccttgctgtgctgttgtccaggctgcccccccccacccccctgcagtcacgtttcctccttgatttggtgtccttgcccctctgggctgcagctgcccttccaggcttcctgctgtgttagttcctccttttctcctcccgaccggattcatctctggtccagatcttactgctgcagaccagctacccttctctggataattcctctatacctggcacaggggagatggaggcagagagatgaatccatcctattttttctaccttcaagcagctggcattagcgtaggaagacttggaggaaaatacatcactgcacaaggtgtgattcaggctagaagaggagtgtgcaggaggtataggagcctgaaagaggattgctgagctctgcccaggatgggggctcaccagtgaaaagggagggtaacaataagagaaaacccagagggataactacctgccaggcagtgtgggaagttctttgtttagattaactcacatgatccttccaacaaaccaaggtgggctctattactaaccccatcttgcagacgagcagacagaggcccagaggggtagtaccctgcttgctgaaggtcacaaagtcaagtgtgccagagccagaactggaatccatccagcaactgtgctgcttcagagatggttctgctgtccccaggctgcactgactccctttccaggagaattaagtgttttacagagagaacaacagggatgaaagcaggccacagtgtgcttggaaaatggtgggcccttttgctttgctggatcagtggggaatactgcaggcacagccagaaggcttaatgtgcactgaggaatcctgccctggttctgcaggtatgaagaagcagtccctggaaactgccacaacccctctgcaaaaatacagttgtgcccccttatctacaagatgagttccaacccacccagtggatgcctgacactgtggatagtactgaaccctactgatgtggtttggctctgtgtcctcaaccaaatctcatattgagttgtaatccccagtgctgggggaaggatccagagggaggtgattggattatggagacagacttcccccttgctgttctcatgatagtgagtaagttcttatgagatctggttgtttaaaagcgtgtagccttaaacaaggataaatggggactaattggtgttggctcagctcatgtgggcaacccatgtggggtggccaggctgctgagaggctgccagccaggtcccatgagggcccctgctccagactctcagccagggcaaccctttccactggcccccttcactctctctctctcctgatctgccatgtgaagattgtgcttgttttcccttcaccttctgccataactgtaagtttcctgaggtctgccagccatgcttcctgtacagcctgtggaactgtgagtcaattaaagctcttttcttcataaattacccagtctcaggtagttctttatagcagtgtgagaacagattaatgaacccatatttactatgttttttcctatatgtacatacccatgataacatttaatttataaattaggcacagcaagagattaagaacaataaataaaaacaaaatagaacaagcataacaatacgctggtatcactactcttgcacttggggccataattaagtaaaataacgattatccaaacacaagcactgtgacaccttgacagatctgataactgagatggctactaagtgatgaccagcaattagcatatacagcgtggatactatggacaagggaatgattcatatcctggtggcatggagcaaaattgtgtgagatttcatcacactactcagaatgcagcccaatttaaaagttataaattgtttacttctggtattttccatttaatattttcagaccgcagttgactgtgggtaacggatactgtagaaaggaaactgtggatgagggggaactactatagccattctcaaatgctgaattcagttgttagggtggtgagagacaaatttaaaagtagagaagacaggcaatggagtcagaatggaattagagatatgcatttgccaatcaatagctcagtgactttgtaaaacttcctgtctccacccaagactcagcttccttatttctaagttaatcatgcccactcttctcattgagcaacatgaaaaatgggctccataagtatcacctgctattgctatgactactattagggagctggtggctttcctgaccatggctcttattccagacctcttggttatcacttagaaaaaggaaaataccaagagatgctcatgaagtttgttaatcatgaccacttttgatccacctttttgccttcaatccacttaaccaccctgtgaagcgggtgctcatgtcctgattttatacaggaggaaactgaagccgcaaagtgttaaatgacttgacctcagttcatatagcaagaaagcaacagggtcaagattggaaccctgacctgcttgactctgaagtcagagcccctcacctcaactgtaccatataaaatgaatgaactcagcacaacccggtgtctcatcaaaatgccctttgtgaccctacttggccatctaccatacttctataggagcttaaaggaatgtagatgagatcttgctatgtggttgtccacttcatgggatcctggagctctcttttcctgcaaattgctgggtggccttactcaagtcatctcatctctctgagtttcatcattttgacctgaaagatggggaacacaactctgttctcccttattcatgagaatgccatgaggataaaatatatgcttaaaccattcagaacacatgatgattaataattcaattccccacctgaacaaaacctgaaacagcaaagtgaaatacacaaaataaattaagccaagagtaattattcattttgcaaaagggttcttcactccacagaagagactcattgacatttttttttccaagcagcagctatctttgggaatttaaaattaaattccatttatacaattatagcaaaaatactaatgattttccagagtgcactttgagtgcaatgggccatacctgtgtgtcctgcccatggcatcagacaaggcagtctagagatccagaaggggtcagagaggagagggacctttgcttttctctagttaggaatttgagaaaaaagaagagaagctggattgtgtgctctttctgaggggttcctttctcagagtgacctcagcctcaattgcaggcagatggtcagggtcacagctagcttccccaggaaacaagaggattgccatttccagtcccttccatctggaatattataccattttacgtaatgtgtacattcagctgaacccagctaattttcactttgctaatctcatttctgattatatttgggttttttttttttttttgatgaagttttgcttttgtcacccagattggaatgcaattgtgcaatctcggctcactgcaacctccacctcctgggttcaagtgattctcctgtctcagcctccctagtagctgggattacaggcacccgccaccaggcccagctaatttttgtaattttagtagagacagggtttcatcatgttggccaggttagtctcaaacacctgacctcaggtgatccgcctgcctcggcctcccaaagtgctgggattacaggcttctgctttatgttttctctcttttgcttcatctctgtctctctttctgtttctcaacgttgtttttgtcacagcctcggtttctctctttggtctctgcttctgttttttctttctcactgtgtgtctatgttctttactatttgtctttctctatgtctccttttcttttagaatgctctgcagtaaaaataacttgagtttagagtcagagaggtccaagtaaaatccccaaatccactttaatttccttatccacaaatataaaaaagtatggtctgccttctttaaggttcaatatgaagatgaaataagacatggcacataaaggtgccaccaaaaaagagtacagtcatttcctgttaaatcaatttcccccttcctttcttcttaaaagttcttttgtttgtttgtttgcttttaagacaaagtctcgctctgtcacccaggctggaatgcagttgcacgatctcagctcctgcaacctctgcctcttgggttcaagcgattctcctgcctccgcctcccgagtagctgggactacaggcatgcaccaccatgctcggctagttttctattttttagtagaaatgaggtctcaccatgctggccaagctggtctctaactcctggcctcaagtgattgatctgcctcctccagcctcccaaagtgtttggataacgtgcataagccaccacacccagcctttcttagagttctttaattttccttctttctcttcccttgtcttcccttccattcactccactgcctttgcaccactctcaaacaaacaagcacactacagcccccactttctggcaatgatttaattgcagaacagtgcaggttcccattaccaaggctctcattcttttacaaaacatttttacagtacatttcctgggatataatggagaatcattgtgagtcattaaaattaagcaacgtgtgtctaagcagcctgcatcaggcttcactacagagtcaggtttcattgttaggttcacttctggccattggagagtgtgatgggctgttcacaccacactgggtaaggtcacctgaacttacctgagttgtgtgggacattttgaattctggatgccctgtccaaaggaagagtcctggtgttagcaacgtaaatccatactccaactgcccatcacatactcccattttctggtagaaactcaaaccatctagtgaaattttaattaagagaccattcaacatcgtagccaaaaggcagggacataacagaccattcatcacggtagccaaaaggtggggacacacacacacacatacacacagaaacacatactcctccttctattcagaggcctttagtcatccacactgaatcaaatgctgccttcagtctagcaaaaggagagaggatagtgtgctgcaatgggcagactccctacaggcagtatcaaataaccagaaaaggcaagtgctactgctaagtgctgcatttcaaatggtttcctagaggtcccttctgcacagaaatctgtcatcatgccttccatttcatcatgattaagtcttttgtgtgttaagtattgccagcattggggggttctttttgtccctgattcaataattcccatatgttgaacacatatcttttccatataatgtagcagatacttcgtaccgataataatcgtcacaataacttaccaaaggtgaatacttctccctcttattaaaaaaaaaaaaaaaagcagaaaattgaggcttggagaaattaagtgaattgctcaaaattataccaatagtcaggggcagagtcaggggcagagcccctgctcagcctccaccagtggttcccccttgcattcaggacaagatttcagccctggtctgtctgatttcagtcctaggctctttccatgttgccctgactgcctctctaaaaaacaaaacagagcccagcattcatgcagcttgatcatgagctcttggaaggggccagtggtgtctcttttgcttctctccctggtgactgactcaatcttcaggctcagtcaatgtctatgaaacaaagacattaatgaagcttatgaggaacacacatgccccagatcctctgcactgaaacacttatttatatgaatgagcgtacctgagcacatcccttcaagacaagcccagaaaagcaatgccagaaaccagcaccaccttcacatgtggcaagaggccatgcaaaatgtaatggctcaagtttggagctgggaggatgggggcttacatcccaaggataaaatattttgactgcttaatatgttctcaagaggaagaaaattaagcaccattatggtagtgttgcagcctcctctctgccactaagttactgaattactaaatgaaccctcccaaaacctcaagctaatcaggtgtagaaggaagccttgggccagataatctgtagggctcctcccacccctggagccttttgttatatgcctccacagtgcccaatcctacttgttatctcagcagagtctttaaaggcttctcaggagaaggggtagaggcaagggtcattaattaatatttttccctccacatttaagagggcatgtagaattgtgtaaggacagggttatcacctaaaaatgagtgcctccttgaagtttttgcctgaggtgcctcattcagttcattctggtcccagccctgcttgacaaaaggatcagcaaagctctattcaccctctcacttgtatcacatacctgcttcagtgtttctcttctcctttcaccctgagttggtgttgtcatctcctaggtcctatctttagagatggtataaaaactgggtcttgggctcaaacacatgggggacacacaacgagcaggttcctcaactctgatgtcaaagcatgaaatcagttcaccagaacctccctggggcatagacagcagcttcttttgctaactacctccaatactgagcacaatgcctggcacataagtgatgcacactaaataatagcaatgaatgaaatgcaatatctggattctgaatgcttctttctgccttggcttttcccaccctgatccaagccaccaccatctctggcatcacatcagtcttccccatcagtctcccttccaacatgtttacctctgttcctacagatgtttcctcaatagagatgccagagtgatactcttaaaatagaagttagatgacgtcacccctctgctcagacttctccagtggttccccattgcattcagggcaaatgaaaatgctaatgtttttacaatgttctgcaaggccaacccaggggttctggccctctgaacgctctgggatcccatctcctaatatccttctagtacccagttcaacccagcacattagcctctatgatcttcctcaaatatgcaaggcacaatcacccctgtgagcctttgcacagcctgttccctttacctacactatgctttccccagatatccacaaggcatgctttgctcccacaccttttcggttgtgcctgtcttgaacagtctgctcaaatttgcaaccatttctgcaacatgtacagccccctctttctacaggcttcacacacacacacacacacacccctcatcttctaacatgtgatacactttatcacgttattcactataattttattactatatatagtatatacagcaatacaatttcattactatagatactatatataggaataaagtacataagttactatatacagtatctatatatagtaataaaatatataaattactatatttcatatatagtaacgaaatatatttagtaaatagcatgataaagtgtatcatatattatatatagtacattatatatttctacatattcatatactctatatatgtatatacagtatatatatagcactttatatatgtatgtatgtactatatataacatactatatatagtatactttatatagtatgtacatgatatatatatatatatatatatattttaactatattactatatatattttagctctgtgcctgtcccctgccccgcaagaatgtaagttacatggtggcagggatttttttgttttgttttgttttctttcttctgtcagagcctcacatcctggttaaattgggtgcttgataaatatatactgaacgttcagtgaacaaatacatgaatgaatgaataaataccaaagccatttttttcaacttggacatcaaaacattaaatgaattcaatagaccaggaattggcaaaatttttctgtaaagagccaaatgacaaatatgttcaggtttacaagccatagggttgtgactgctcaattctgatgttgtagcacaaaagctgtcatgggcaatatgtaagctaatgagcatggctgtgtttaaataaaaactaatttacaaaaaaacagcagttggcctataggctatagtttgctgactcctgcactggactaaacactattaggtaaggcagtggatctgaattttcttcctgttgaatatcagtacataaacacagcacagtgtctaacacagcattgccactcaataaatattttgaatgaaatgaaatatatatgaaatatagttctgctctttactctgtcacagcactgtctaattgagcttgttgcaacaatggaaatgctctatatctctccaatatgaaagccaccagccagatgtgactgctgaatatttcaaatatggtgaatgtgactgaggagctaaatttaacattttatttcattttaattaatttacattttaatttaaatggccaataatggctaacagctactggattggacagtggagttctatcacaataattctcttgcttcatgattcagttctattatcttccacccccaccagaggaagccttccctgattgctaaggctcacaataacttttttaggatatattcatttcactcaatccatgttttagtcacagctataataataccaaatgtttgttgagctttaagtaccaagtattgtgctcagtgcataatacactttatctagctcagtcctcataattaccctccaaggattgccatgttgatattcttaccactattttacctctgagaaaaacagaagtgtaggaagggtcagcaaagtgtccaaacttgtgcaggacccaagtgggctgggatttgaatcttcatccatttgaatccagagtgcaagctcttgaccaccacaagatgcttattaagtgtaaacacttgtgttagtacaagtttcatgtgttcacatgttatctatccttcaagagatcaggaatcagtggtcttcttcattctacatatttcaaagccagaacactggctttcaataaagattttcagtatacagaacttcagagctggagagtactcagggaaaatctaatggaaatgctctttgtattataaataaagaatatgaggcccatagagaaaaggggacttgtcaaaggtcatactatgggtaaattacaaagctgggattagaggccatggagtttttctctgaattcaatatttcatctttcatgtactaattccaccattcatttttaaacatcaacagtgtgttagacaatgggttgggtatgaggaaaaagcagtggataatgcagacacaatctttgcctttataaggcacacagttttttagatagctagcaattgaacaaagaatgacacaaataaatgtatcattcaaggttgtaattatgtgctgatagcataggcttgtggtttagagggtaaattctgaggccagacttctaggtttcaaatctagacaccatcacttcctaaatgactttggaaaaaatccattaactgtgatttagtttcctcacttgtaaaatgagacgataacactatttcattacattaattctaaggcatgcaacttctgacattttatttttatttccatttttatttatttatttttagatatagagtctcactctgtaacccaggttggattgcagtggtgtgatcatagctcactgacactttgaactcctaggctcaagcactctgctcacctcagcctccaagtggctaggactacaggtgcatgccaccatgcccagctaattttctcagatttttttagagacagcgtctcactatgtttcccaagctggtcttgaactccttgtgatcctcccaccttgaactcaagttcacttgatctcaagttcacttgaactcaagtgatcctcccaccttggcctcccaaagtgctggattacaagtgtgagccaccacacccagcccccatattttaatattcctaaattgaggacttatctgataattattagtatagtatggtatagtatgattattattattggcagtattttttcttagtggtacataaactatatacatatgtgtatgtgtcttaatttatttaaaatataatcacatctacctcatataattattgagagattaaatgagataatatatgtgaaggctttgaagagtggctgacagttatcactgtataaatgtgcaccattattactatttactataaaggaaaaatagcaccaatggagcataatgcattggggaaataaactagtacagaaagtcacttccttgaggaagtgacattttaagttgaaacaagaaagataaggaggagtgaaccaactaaagaatacagtttataagaagtggggctggatgaggaacagattgtcccatgcagaagaaacagcaccatcactaactctattacattggctagaagaaatgactccccattaacaaatatggaactctttacaacatggctttatatcctaataacactctcaattccaacctaggcttcattattatctttttttccatacatttgtttattgataatatatttattgtaaggttttgcatatatatttagaaccttcctggatttattttttaaatagtaggacatatgccatttttagaagaccaatatattttttaacacattttttagataaaattaaatatagtctctaatttaaatgtcagtagattatatttatgatgttaaaatctggtcttaaaagctgagcacttcccctttttggtacctataatcatcagaaatacctgaggctaccttcttcctatatgcagctttgtggtgtgagatttcagatctctgacaaccttttttctttcaagttcagaagcaaaggttgccttggactttcaatgggactggcaagttcccaataagaaaaagttttcatagtctcttttgtagtttaccctaaccttcttgaccttctaaatttttgaacagtcaggcctggtgcttgctttgcaggctccctgaaattttatgacctcatcctagacacagattgtcctttcttaaaagaccttaaacatcttctacaacataacattttacaacacatttaaaccaaatatatcaagactaccaaacagagataaaaagtagtttccctacaacccatacatgctgtcacagttccttctacctctcagttctgtattgtttccctgccctcaattcaattcagtatttttgtttttttcaagtcaacttattcagtaaattctttgtccaaaggattcatgcctgcctctgagaattctatacaaatacctatcaaagggggaatcccagaatgcctctcttttctcaatgctaagcaaatttcctcacatgctaactccttaaaacagtagcttggccaaatcccagcagtaatacttagtaaatatatgaacttgagaatgtcaatcaactactttaagacatagctacttgtattgaagcaaaaataactacctagaagtgttattataataactgagaatagctatataaagtctttgcatggtgtttggtacacaataagtgcctaataattttagatgttgttattgtcacttcaatgttcatgtacttcttgatatctcaccaaaattccattgtacctcttttaactattggctgtatttggctgttgtctaacactccatctgctatatatagataatgaatctgcattgaatggattaatctgatgagagaaatgggatttatgagttactgacttgtttcatggaatgtaagcagaaaactttggtttcttgtcatttcaattacttttgttggaaaatattttaaaaagcttaattccattatctttcatgcctgaataacaaagtatcatgttcgttaatcgataataagttcagatgacttctgtttaattcaggttctagtaaaattcatgacaaatgagtggtgaggtggagagcaatatgggttctgaggatcagagggactcgtttcatggaggatatccccagttgaggctctctggactcatttgtatatgactaattctgaacatataaaggacagaatttaccttatttgagttcagaaaagaccagtgctgcccaagtcaggggaaaaggtgagtttcagaaaaggattaggtatctctgagcaagtctttatttagcaaacacacactttagccagagtgttgtcagcaccctgagaactctccatggtgctgacacaagaagcctacaccttactcattgaacaagccttgacactttagcagctgaaatttgattttcatccatccatccatccatccatacatccatccatacatccatgcatccatgcatccaagaaaagatgtattgatacaggaactgtttcatttccagatacagcaataaacaaggtgagcaaagaccaagacttttataatgtatatacccatatacaaatgtcccctctacagtctgccagaaagttggttctctataaacaaatatcagcatatcttactgtggattttacctacttattgccatacttcaatatatatgctctaccacatagaaagccctaaagataccacttccttcaaaacagggaatttctccatcactgtagattcttggaatttatagcttcataaaaatcctgtatccctttaaactttagtaacacagagctcagcaaatactagaaacaatctgtaaacattagaaatatttagtacaatataagattgctatatgacataaccacatacagtgtattctcatttcatatcctactacaaatgaaaagtggctgctgaagacatggaaataaactgaatgtaatggtgaacatgactgaagttcatatcaattgtggaaagaaaattcaatttgctataaatgccatttacaaattgtttcaatcatacttacatgctaagttattagtgcttaaaaggtcatagaaacatggattttgagcggagaatatcctagaaattatttagacttttaatttgtatcttgccactaatttacggtgtgacacagggcaatgtgcttagccttggtgggtcttggtctcctcatttgattacactagatgatggctaggaactcttcttgcactaaaagtatgtccccactcattgctttgttgaagagaaggaatctgaagttcacggtatgtaacatactcaaggtcgactggcaaatttgtggcaaagttgacatgagggttgaagattgaaggttagtaattattttctttctttcctctttctttctttctctctttcttttttttttttttttttttttttttttttggacagagtctcactctgtcacccaggctggagtgcactggtgaaatctcagctcactgcaaccttcgcctctcaggctcaagcaaatcttgtgcctcaacctcccaagtagctgagattatgggcatgtaccaccacgctcagctaatttttgtatttttagtagagacagagtttcacagtgtgggccaggctggtctcgaactcctggcctcaagtgatccacctgccttagcgtcccaaagttctgggattacaggaacgagccaccatgcctggccagtaatttttttcattgcaaaagttcagaagtcacacaaggactaaataaaagttcagcagatagaaatgtctagcttactctaaattcctccttcagctggttagctactagctggttagcagagatgatatcatattttcttctcacataatctaatgttatgcacattgttggattaaacgtctcatgaaatatttattgaattaataagtgaagatacacatgactgaataaatgattatagaaataagagaaaaccttgtattgggtttccaccatatattatccactgcaccagtgcattttaaattttatttttcatctcatccttatgacaactctaaaaagttgaaattattcttctcatttttagttataaaaaataaggcttgaatatgttaaatgacttaccaagctccctacaaccaggaaacagagaagagagaatttaaacctggctgtgtctgactcaggaagatatcccaattctactgtggttcactacatgcttgaatgaatgaataaacatatgaaagaatgagttagtgttccgctgtcatttgctttatgtgttgtagaccatattgtcaaaggttttatttacagaacttggtgtgatgccacagatgtgcagaactttaataaagctgtttcgcaataagacattacccacattgatattcttgagagtcaaagcctaatgatttaaactgtgtggtgttgcattttactggaccagagcaagtagtccttggatgttcactttctgtcctcagagagatgaagataatggtagtctgtcctgggaaggagcataatgtcactctggtgacatgttcaagcctccactagccacttttttgccttggtctttcattggtttgttctcatctcatccagtgttgtgctggtaaatgtttaatgattgtctttctgaaaaaaataaactctgattttgttgcatttaccaattgtgttggtgtaaacatcctcaccatagcatattttcaggctatcaacatgccatcactgaacaaagagttgggaaaagatgttaacagtcaactctcatgatgccatgtgagctggctccagcacatcacagatctaattccagagtcatccctgtgggtggcactaattgttgaaatccctggaaaaacacactggaaatgggctgtggcatgcagccaggaaaacttggccaggttcatctgtgcaccaagacaattatatatatgtttcagctgtagcatcttctccactttccttctccttccctgtcacttgggagaaaaaatttttcttatcaacacatccagaaaagctttaaggaatgataaccagtgctttgactccatgactctgtccagctctacagatttgactcacaaaggagagacttctttaaaagaagctaagccacttttgacatatcaagacctaaatatacatagggcttcagggtttagtttttccatgactttccccaaattctaattcctgatgggaagcaaagagtggagaaagttctagctgttcttttagggagttagatgctctccaaaacaggtggactcatctgcttgtgagaacagatgttctcaaagtctttggatccttaccttttaatgacctctcttcatattaccttcccaacctcatcccctgccactctcccagtgctctgcctgcacctcattctccagagggtgcagtacaactaaactgacctctgagtcctagaatcattataaacttttctgtttttcaaaaaatcaagttccctctgctaaagcaccctccatactcatagtccctattgattttacaaagctgagctgaaaggtcatcttcttcatgatgtatctcctgaaatccccatctagaatacatttctccctgttcttcaggcatggggcactttgttaatgcattgctcttgatttatactacactgtgtttttgataatagctatatatgagcagattatttttatacctgtgagaatgtaaaatccatgaaggtaagaatattgtgcaatttgtctgtgatttcccataacactcaacacaccgacttatgagttgcagaattaagaaaatcttgcttgaattgaatctaatgaattgaactaaattttacaaagtggatctgagttaagccccatgaaaatatatttagggatcttatgttcctatttcaattttctacctgtagacagtcctatccatttatgccttgagtgacttagagcaaggtgctttgctgggcattgcggtggaaagaatataggaataaatatgatctctggccctaaggagttgactttctagcaggggagataaactttcaaacagtaactcaagttttaatctggtttttagtcaacaaagaactctgatgattctgtagaagaagtaatccattctactgagaagaagtaagaagaaattaaatgagtaggattgtggaaggtagatgattaaagggtggaagacatttcaggtggagagacgagttgaactctagtcagaaggtgaaactacatgggaatgtttggggaataattgtgagtatgagcagagtaagcaatggaaagagggatgatgttggagatgtgttggaataagagagtaagaccagggtatcctagaattcagatacatggatgctgcacagttgttggcgacccagtttttctagatctgcaaaatatttaacttgagttcttatgtaaatggataaaaggggaaaaactagaattggtatatacaattgtttcaagaagcatcaggaggaaaattccgttcttccttcctgcttgtattattctttgtctcttaattacatgtcaggcattatgctgaattttaaagatagcaagaaaagtgaaacagacatcttgaacctcccgccttgctccagcaaagtttacagtctggtgatagttccagacaaggaaagaacaatgactccatagaggaacaaagccatgacatatggaagcacagaaggctatgacagtaggtgggagggccccttcatctgttcagggctagagagaggggttcaggaatgccacctgtaggaggaaaagtgtttgggctgaacgtgtaggaaataaaaagaagcccttgctctcccattaaaaggaaaaagacatttttctttttctgtgaaagggacagaggcatgcgagggcatggtgccttcaggaaactgcacatgggtagtgtacctagaacccaggacacaaggcaaatacaggcagaagatgaggtgaaagaaacagacacagttttgtcaagataattaaactaacaaatttggcaactgagtcatcccctgtgagtgcagaacacgggtggactatttgggagtgttcagagccttgctgcaacagggtagtccttgagccagaagcatcagcaacagctcccagcttgttagaaatgcagaacctcaggcttaactccagacctgctgaggtttcagaagcactggttgaaggcatggaaacctggctttatatcctggctttgcagtttgccagctgtgtgatcttcgtcctgtcccctgtcttctctgggcggcagtagaatcagccatgaagttgaggaggtggacctagtggattccagtgatatttccagctctaaagagtggtgtgtgtgtgtgtgtgtgtgtgtatttaaatctagaggctattggtggaagagtgccttatttttcaaactggctaacacacaccttggatgacccgctgtttagaattatgccctcaagcctgtgtctaatggagaacagcattagaaaccacaaacttgcacctgaaagcagatcagctggggagctagaaggtcagacccacaggcactcaccacttgtctactgggcttcacagatggaggcaaagaaggggaccccttctgttccttccaccaataatcttgcttccttttcaaggaaaaataatggaaaaaaaaatctaaggggccagatgcagagatatataatcccacaagggcttacctggcttttgggtaagaatatcctagaatttgtgtttctttcacgcgcgcgcgcgcgtgtgtgtgtgtgtgtgtgtgtgttttgcgtgttggggtactggttagggtggcagtgacttaaagcttaaatatcttgattaaaaaaaagaagcttggctgtctggtcatatgatgcataagagctgtgttacattttcacatagcttctccagttgggctatttatttattgattgatttttgggacaaggtctcactctgttgctcaggctacagtgcagtagcatgatcatggctaactgtagcctcgacttccaggactcaagcaaccctcccacctcagcttctagagtagctgggactatgggcatgtgtcaccatgcctggctaattttcgtatttttttgtagaaacaagatttcactatgttgcccaggctggtcttggactcctgggctcaagcgatccacttgcttcagcctctcagtgctgggattacaggtgtgaggcatcgcacctggcccagttggcctatatagaggctacaaaaaatatgctgaaacaggctcctgactaaacaattagagggaatggcggttataaagccaaatcatggccctacctggcagagacacaaaagttaacctggagaagtcgtctccttacttctgaacaggtgtcccattgagaggtgaagaaatcctcaaatagagggaggagatccttgacctggactactacactgagcactgagacctctgacctctgcacagaggctgttgtcatggtattcacgtaaccagtttttcgtgcaagccagccagactcttgtgaatggagagaaagatgaagttccagagaaaacagaccaataacaattatagggggaagcagaagactgaaagtaaggaaacctgaggttctaatcctggcttcacttgtaacttgctttgaaaccttggtaagttcctttttctttctggctcctgttctctatttgaggacaataagaacatcatttattgagtatcaactatgaataagatactacccatttaatgagcatttagtataaataagatagtgtctcatgggtttaaatgtcatctagatgctgtagactagcaaatttctatccccagctaagacttcttctttgaatttgagttgtggacctgtagtcgattttttttttttttttttttttttgagacacagtcttgctctgtcaccaggctggagtgcagtggcatgatctcagttcactataaccttcacctcctgggttcaaacaattcccttgcctcaacctctgagtagctaggactacaagcatgtgccaccaagcccagctatttttttttttttgtattttagtagacagggtttcaccatgttggccaggatggtcttgatctcctgacctagtgatccacctgtcttggcctcccaaagtgctgggattacaggcgagagttcttataattttatgttgtcttggcacccatttaaaatacaagtttaattttttccatcagaagtagggctcagtcatccttgacaaaatttatagttgtacacttccttccagttcctcaatgtggtcaatccaggtacgtgcctgcaatggaaatgacacagcaaaggtggctgcctggacaacagaagcagaccaccacaccaaaatggcccaagccagtggccagagataagaacttagaggcatctttcccacctagcagatgggcttcctgctttcttgtcacttcctttacaggtatcattcagacatttgctcatgaacttaaagtgacccatatcctattccccagtacatacttctctctctctctctctctctctgtctctctctctgcctgattcttcactcctgtcttgcttcctgtgacccagggacagaagattgccttcctgactcaggatctgtaagtaattaatccttgaacttgtttcccattgtggtgtttaattgaatctgtgccttctgtttgaagaagcaggggctatcctaggccctggatgttggggagaacacaagtgcaggctcccagcaccagactgatggtcaggcaggcattaactgcacacaggttagaaaaaccaccaagggtggcagccagtgtaatcaaacttcctgtgtgagggactcctgggtcaccatcagacaaccagatcttagggtgcccaccaggtaaaagaagtatcccatgaagggcacactgtaaacacccacacccagccccactttatttcccattttggcagggttgctagaggttctactactggaaccccaatttagcagggggctcttagatcaggacccaaatgcccattctccattgatgtttagtagtcatcttgaacttacacccaaaacaacactctttatcttcctcacccaaccctgaccttcccactgcatcccctgactcagtaaatagtaactcaatgtgtcccattgttcagactgaaaaatttgggataatctttgactccactctatttcttgcattctattctcagtaataaattctgttgagggtatactcttaaatgtatccagaatctgatcactgttcaccatcttcttctcttacctccatggtccaagccactaccaactcttgcctagattagagtaatagggcctttgaacacccctgaatcaacttaccacacagcagccagaatggtcctattcaaatgcaggtcatagcatgttgcttctttactgagaatctcccaaggactgtccatcttcctcagagtagaatctgaagtccatattatagtatacaaggccctgaggaccaccatgcccccaaacttcttcttctcagctttcttctcctactccccctctttctcactccccatcctggccccactactagtgctaaataaacagcacattaggctgggcgtgatggctcacacgtgtaatcccagcactttgggaggccgaggtgggcggatcatgaagtcaggagttcaagactagcctgaccaacatggtgaaaccccccatctctactaaaaatacaaaaattagcgacgtgtggtgatgcgtgcctgtaatccccgctactcaggaggctgaggcaggagaatcacttgaacctgggaggcggaggttgcagtgagtcgagatcacgccactgactcttttacctccttctgcctggaacacgtccctcggatattgacatggtttattctcccatcttgaggtgtgtgctcaaatgtcatcttctcagagaggcctcccctgaccactttctgtataatgaaactccacccaaactcccagcttagcactccacatgctttgtacatcattcttttcccctacaccggcatctatcatcacctaacagagtcatataatttacctgcttgtttgaccactgcagcactgtcccatagaaattttcagagtgatgaagatattctatatctatgttgtgcaacaatgtagctgctagtgtgtggctatggaacacttgaaatctgggtggtatgactgggaaaatgaatgtttacttttatttaatttcaattaatttaaaataaaatgccacatgtagctagtggctaccatattccacagtgcatgtttagtgtctaccccactagcatgtaagcttcatgagggtggagattttgcatattttgatcactgctgtcttcccaatacctaaaaatatgcctggctactaaagaaatacctgttgagtgaattaatgaatatgctgtgagatttccacacagcttctcattcaatcctaatgacagttttgtgggttggtgctattttcattctcttgtactgaaaggtaggcagtgtcttgctcaagatcacccagctagtaccaagaagataggctctgaatgcagggatatctgaagtgcagacattttgcttgtctggagctaggccagatgttctctgtggtcctttcttactctgagagtctgtggctctctaagaatttccccccttgaaaggcaatggcagcacatacattagtgtttattagattgatgggccttcttattcagccacttgtcaatggctcagaatccatggttctttaggtagagggagcacaatgcctctttcaacccagcctctcccaccttctatccccatcccggctcccatggctcaccggtttctgggtcgcagagctgctcacaggcatctgtcgtcctttgtccacagaggtccctcacccatggggaggtggcattgatctggtaatacagggaaagcttggccgggtttaaccagtcggagatgtccaggtagctcccttcactcaccacgaagctgcttcctatgggtgaacggagagacagatactttcttactgattttaaggtcttagctgatgctacagaacacagaaaggtgtgtacaagccacgttccccaggtcatctgatctcatttgtctaagtgcacttgcaatgtgcccgtcatggtgttgcaagcccatagggagatagaggcaaatcaaacatgggagataattcaacctagtgatgaaagataggcccttaggactgagagggaagtagggtcaaattcagaatctgcccttactaggcattgactttgggcaagtcacaaagtgcccctgggtcttggttacttcctctgtaaaggagaatattaatggaatgtacctcatggagttgataggggaatgaaataaattcatgtagataaaatgctgagctggcacctgacttattataggaaataatgattaaacattaaatttcaaaggaaaagaaaaaagctaatgtccctgtcactcagatgtctcctctggaacaggggtcattgatgtccacaggggccaggtggctaacatcaataggaaagactggctgagtgtgagggaaatagcatccaggcctcctcacctagcttgtgttgtttgtttttgttttattataagaaagacagaaagatatagagagacagactgagatagagaaaacggagacaaagtgagatttccaaagaaatccccagcacctctaaggaaaagagcagcactcacccaagaaaaaaatgccctgatgtggcaaaacaatagggagaaggagaaggtggggtttgggacacaataaacactgtaggctccattaaaatggagcagctatgactcagctccagcagctcttgccacatggaactaaaggctagtggcactagatcttcagattttcttcaggagaagctaaatattaacatttttattattatcaaccaatttttcaacatttctgatggctaacatttcttcttgaatacttgcgtaggccaatatttgctctaaaatgttccttatcccacatatatgtggaaacatacatatattatatagtactatattacatataaatgtataataataatctatgtagatattccacatacatgcacatgttcacacacatatacatacacacacactttttttgggaggcaagaaacagaagcccattcaggatggctgcatgtaagttgcaaatggtgagtgtatgcatgtatagcaataaaacaaaacaaagatagaatttcacagggggaaaaatatgtacccaaacagaaccaggcttcacaaagctggacagggagcgtgagtctagactgatggcagatctagagactgcagcagcaggagactttaaattgtattttataattaacatgactcagcttctctccttgtttctacctcactgtcaagtaaaaacaaagaaacacatctttgtgtatgcaattcaagttctccaaagacagactcagttaataagaatcatatgggttctatggaggtctatctgtcaggtcacatcttactctgctggctgacctatggttggactcctcttggctctggtgcacagctgtggtccaatgagcaatggccagggaggtgggatcacatcagaccacacctggctgtctgagcatctaagactgtgggaggagaagtttccctggaaatagtaagggtatgattggcaatgattatcttctctaattcacacacatcatatgatttctgtcatcctatgcaataaatccctaagtaaaggcacagtggacaacataattttggtgcaaaagaaagaggggtctttgtgaagtaggaggaatagacagtatcaggactgaggtaaggaaatgaccacatttcaagttggccctaaagtccttggcagctaaagcaaaaatggaaggagtttgttggattccatatttcaaatttctggcaggagaagatatgcaaatctatctgcaaagccatatttcccccctggaaataagcccaagcagaaacatgtcacatgggtccttgaggaaggcacagaacatcagtaccaactacagatttttctttaaaaaagcacagtcatgctgtttaaatggataattcttgtatttattctcactaaagactgaaagatggatattgaattgtgtcccagggctgagtttggttaaaccctctacttcaggaaagctacacagtgcagtgataaagagaatagaatcagcaaggtaagagttcatatcctcactttttaacttaccagctctgcaaacttgggcaaaaaaacaaaccctcagttatcatatatgaaaagtgtgataccaattcccttttcatagcttgatataaagattacataagacaatgcatttgtcttaggtcagaatcatcagaaaacagactcagaggcagacacaggcattcaggatgttttggggtacatattcttgtaagaggatgagcaaagtgggattgggcaaaaggagaggtcaaactgacatacagcaaatccctcagctgatcccatggggagatctggggctgggatggtccttcagtgatgttccaaatcaagacaaagatgtcaggactttctatcctcacattggccagtcataagctgtgagctatccctggagaggggacataatcttgtgtgaagtggtccctttcaaaggaaggcatttctcaaaaaaggactcagctgagagtggtcaaccatccacatttctggcagctggggaataagtgcctaggtgctgactggaaacctgagtgcagcatcatgatgtccactacaagctctgtgaaatctcaaggaacaggagctattttggttattattttgaattcttatgaacttagaagctctaaatgcaataccagtaaacagatttctctcaattatgagaaatatgggtttccatgaaagagattggcttgaaagcaggtacaataaatggaaagtttgtgtcctcccaaatccctatgttgaaacctaatccccaatgtggtgatatttggaagtggagtctttgggaggtgattacatgggtggagcccctaaatgggatgagtgtccttatcaaagagactccagagagttccctcactccttccaccatgtgagaacacagggagaagtggccatttgtgaataaggaaatggacccttatcaaacacttaatattttagcaccttgatcttggaatctgcagtctccagaactgtaagaaataaatttctgttgtttataaaccaactgctatagtagactgaacaaactaagacagcagtttatccttaatgtctttaaaaagatattatgcagagttatacatttggtttaatggcagaagggagttactatcctttgaatgtcctctgctcattcgtggcatgaatgtgatatgtattctgctcatttaatccttacaacagcctttcaggataggtatttcttccaattgaacatgaggttcagagagaaattgacatggtcaaatttgcacaaccagtaagtggccaaagtggaacttaaaccaagatttttcagccttcgaagctggaacatttgcctttcttcaagctatcttgaggctcaggggttttggtcagttgctttttatggtccttttcctctgtctagagtagtctgtgaattcctctttagtgcatatcatgtagagttggagggcttttgctttctctcatagaccgtgatttcctacagagaagaggtcatgactcgttagtccttatcaatccaactctcagtaaaatgcctggcacatactaggactttagtgaatgtcaagtgcattaatgaaatcagagttccatgcttgactagagggaagttcaattcacttcatcatggaattgtgaagcagaaatgcctccacgttgatctcacagtttaatttttccatcctgtgagagccagaatacaagactagcccttcagaacctccccagttccaaactaaatgtcgaacatcactatcgtggctcctgagctcttattcacccaatgggctcatgatgcatatggcaaaagtagagaggcaggtagagaaactcagtgacaagggtcaagggaggtgccatatcagagcctgaaaagaagtaactttgtgccaaatttaatgtaaccatttacccaacgttgattaaactccttcctgcgtaagaaatagacatagagactaagaaatgggcttaatccattgagaaagttagggataaaacaagagagatcaaatatctgcccagatatctttaatacaacctacagtgtggtaagaattgcctgaaaaatataggcattgtctttggatataagggagaggaaaaaggggactcaaagaggaacattgaagagttggcctttaagctataccttgaaggatgcaaaggagaccatgacataatgaactgttccctccagagtaagtgggagtaagtggccacctgtgtggcatttaccccttaaggctagactccataactggcctgcactactcttaatctctttattatttgcaaggcactccactcaagtagcacctatatgtgctgtgctagagtgtcattcattcactcagatatggctatgcgccaagccctgcagcaggctctggttgagtaaaatatggcgtctgcctactgagaacttatagcccagaaaggaagatcagatatgaaaaatctaaggcaaagcatgactgtctgctcccctccccccatccctcactttccttacttatttgcccatcagattgtgcatttcttgaaggcaaagcccggcttcatttaactctacaatcactgccatgcttagggtgaagttgaggttcagtgtgggcatgtgagagagaacaagagagaaagagagcactaagtttaaggaatgtctagcagagctctctgaataaattccatttatttgggaatacaaactacacagaaaaggaataaaaggcactattccatgtgtctcatgtttttctagtttttctttggacccttgttttattttttggctttcaattaaaagtgtcctccccactttactgactgttctgagttcctctctacactcatatagatctccccagagagcaatgactctgaaataaatctctgccaaaatctcaacttcaaaatgtcatgtttccttatttttaaatatatatatatatatatatttttttttttctcccacttacttgtgggaatatacatcatctaattagctaaatggattttcagttcagcccaatcatttcgttatctagcatctgaagcccagtgttgctcaggggactgcacgggcacggaggtcctcattaactctgatcttcaattacattgattatcagcctgcttctgtaattgtgcagcatagatcaggggtgagctggggagctcaggccactctgtagcatactctgaaaagccagaggcacatcagccaccaaagaaacagaaggctacagatgagaactaaaaataccacggaaggaggtatcaccagacaaaattgcctggagagccagacagcagctgcaaatccctttcattacacctcacatcatgaaatagacctctgagaaccatggatagatttcaaaagaaggctctggtcacagtggcaaatggtgagcagaataatgaaagatgtgtggctaaaagatggtctttacaaatgaagtgtagagactgttttggtcaaaagttttcatttttattttccctctttctttgggtaaaaataattaaagattccctcccttctgttacatcatgaataccacgggtcctagctgtcttggacctgggagaaatgtcttcctggaaacaagatgaaaaacaaactgtgtgatgaagcaggaatgaagatcatatctactatcagcccgacagacccaagaagaatgtatcacttttacccttctcccaggtccacagagccccaagtcaggctttaatacattccaccacctaccatcaacagaaaactatttacggggtgggtgatagaactgcaaaaatgtggttaaaaacaagcttgagggtttttgagtatgggtaaaggcaacctggatacctgggagaaaacagtctctgagagcaaccactctggaggaacattatcgtgggggtggttctcctacaaggatcttcaagagtcctcctccggttatctctgtcttcacttcctgaccttccactcccagctctttcctctgtcatcttctttccttttgccttggatcaaccccagccttcttctattcttctctatggttcctacttgttatgggttggactgtgttctgccccaaattcatatgctgcagttctaacctctagtgtctcagaatgtgactgtccttgaagacagggtcttcaaagaggtaattcaggttaaatgaggtcattagggcgggtcctatttcaatacgactgatgtccttataagaagaggatattggggcccaggtacacatagaggaatgaccatctgaggacacagggagaggacagccatctacaagccaaggagagaggccccagaagaaaccagctctgctgacaccatgatctcaaacttctaacctccagaaatatgagaaaataaatttctgttgcttaagcaactcaggctatgaaacttttttctttatggcagccctagcaaattacctctatcttatttctttttgtttgttgtttgttgttgttgttgttgttgaaacagctctaactcacccaggctagagtgcagtggtgcgatgactcactgcagcctcgacctccctggctcaggtgatcctcccaccttagcctcccaggtagctaggactacagagacactacaggaccatcacacctgactaattttttgtgtttttttgtagagacaggattttgacatgttgcccaagctggtctcaaactcctgggctcaagcgatccacctgccttggcctctcaaagtgttgggattacaggtgtgaacccctgcccttggccacctctgacttctttgacagcaaatatctcaagcttgccatttgctccacttagtaacctttattttgtgcttgggatacctatgaatcacttctcagaataaagctttcaaatgtataaaaccaaatttatagtataacaaatgtcatgaataagtgaagcacagttctatcaatggaccccctggaggttcatggagctcaggataaaaacccaagtctgaactaagctattttcatccactccccagataccaagtctggtgtcttttctggttccaaacacttccaacatcactggatggacagagggattattataatacccataaagtgtgtgaatcagatggaaatgacaaagcgaagaaagaagctaagaaaatgctgagatgttccagtggttattttaaggacagtcaacctctttctgttaattttacatgaaagtactttttttttcatgctctgaagaagatagcaacttggttaagattggggtttcctggaatcattatacaacagattagaagtttatggtgttatgctagttatatatctaattttacagactatcagaaaaatttgagtctttctagtccagaatctctcaacttttaatatttttatcaagtgtttttagacatttttccttaaccacctcccacccatgaaattttaataccagagatatattgtatatctgcttatacactgtatgtactgtttatatactatgctttcactgtacatagattaaatattttcactccctccccaagatcaatttttacttctttggggatgttatgtccttattgagaatgtatgttataatcagacccttttgcagagataaggaaactgagggtcaaggcaaggggcaggggaggtgcccaagatcccctctgggattagtgaagtagccacagctagaacatggactttgtgactctcaacctcttctggtcatgagggaggtgggagtgagagaagtcaactgactctccaagagccacaggtgtcagggctagaccagaatctaagtgccataacttctaagagctcagagtctgtgccagtatcttccactgacaatcaagaaccgtcctggtggagggaaactgtcactgggctagagcccagtgggagtaggaaatgctaataactgtgagaggaccacttcatagaagagacattgagatctcatcactgcatatcccagaaaaaagaccatggagatgaacagtccactgggatttggggtattctaggttttatatatatatctatatctatatctatctatctatatatatatatatatatatatatatatataacctatatatatgttacatatatataggttatatatatatgttacatatatataggttatatatatatgttatatatataggttatatataggttttatatataggttatatataggttttatatatataggttatatataggttatatatatgttttatatatatatatatgtttttccaaataaagctgtatcaaaatacacctatttccaaatagacatcttcctgaagtgctgtgcccaaatttgctccaggcaaatgtgtgtctactgttttctgtcttccctacctcagacttgtgatcaaagtctggctgaaaacacgttgccacagaattctgcatgcctttatgtatctacggtcttgcttcaaagttgagttaggggtgtttgagtctggacaaaaaaggtttgaagttttgacgtttcaaaaaagtatcttttcccccaagaatacagcagtttggtaccaaactaggcaatgggaaaagaataaagtcatgacatgttttctcatttttctttaatcatttaaatttttaaagaagaattttggctgaaggttgaaagcaactcttttcttttaatttaattctttctttattttttgaactctttttatgacttcattgggaatttaggcatcagacccaattttagtgttggatttcttttttaactaagatctgtgctgtttgaatgaacatggttgacgactactccccaaacccaaaggtgatttagctctgaattcctaatactgaaaaatctctctccatgtcagttgctcaagtaagacacgaacttagatggaaactttgataggagtctaacgggaacagattaaatctggcccagccactgagttgctgtacgattctagaacaaatcacatagtcttggtaagcctcctgcatttcttaatctgtaccatgtgaataatgcttacttcatagagcttctatggaaattaaataagattcatttggatttcctatggatagtaaagttcctggctaaggccttcatgtttttttattgtagggacaaaatgtacatgataaattacacattccatttacaattgtatatctgtctgtatatacaatacatattactatatattttgcatgtgtatatacaattggtaattgtgtatgtccatgtttatgtgcatacacacttgtacatacacataagcacagataattctgtcaataatgtgtcctatatagatggtgtcttctgaaattgtgcaacatggtgatcctccttgggacacagccagatatcagtctcattaaaaaaaaaaaaaagtcaccttgctctcacttacccaggctagactcattttttctaggctgacttatcctagcagcttttcccctgattgtcacaataccctgggatgatcggcgtagggtgggaatgagggaccctacttgaagacatgttgcgagagtgaggaaccactgtggggtcctagaagtatgcctggcatatattaggtgcaatacctttggaatgaaaatttatggtaagacatgaatagctgagtaaattaacaaatgaatgagtgcaccttgtggcctacaggacccaccagcttcactatgctccctgcagcctgtttccacttcttagggtctacccttttgtatgagatgtgcttccttctgcctttcccaagaaatctgcagaaacatcaggagctgtttggaaaagacagctcacaactgtgagcactaagaataaccatattagcaattcttccccaaatctctttcattactacactgtgggttcgatgccaactgaccaaattaggcataggcacctgcctgcttgtgtctcttgtgtcagtgtgtgtatgtttgtaagtgttcctttttctctagatctcttcctttctactctcttctgtctggaattggcttcactggaaaaagcatagaccttgaagtgggcaggcacatctggattcaaatggtgccttgacagttcatcatttgagtgaccctgggaaatgcttgatatttcttttctctgcttgctcatctaaaagagggtgaatagcacttatcttgcagtatttgcaaggtaaatgtaagtctgtgtctgtgcctcactcattgaatgcacatggaaaatgggatttttttttactactgctattgcttagaaataccagtagagggtaggtgttacttttattcccattgtacagacaaggaaattggagctaaaagaggttaactgtacatgtcctaaattgcacagctaggaaactgatgattcaaaattagaatgcaggctacctgactctgactccagagctctgttaacacatggctgcctcgcattctgcttgcttcaaggaaaacctatccacatcactaagatttctggttgttgtatttttctttttcgcttctgtcaacatacatctctcattacttctgtaaatactgagcttctcatggtggtagctggaacataaatcataccatgttgaaagagagggagaaaaaaaaacaaagaagtcagggagaaggtgacataatattgtaattcaatacttaatatctccaaagacatgtaatacatcgtcatgacattttcaggagatattttctggaaattggacaataattcaaattaatgctaagcctaaatctaattattttatgatgctacaaaggactacatggggccaagcatccaaaaatcagcggtttcaacagtcatgttgatgaaacaaatttcactgccaggcacggatgagaacagctgcctaaatatacaatattaatacctggggcaatgtaataacagggaactgcagcctagccacactgtagccttctcagcaaccagcctttcaccagccaagtcctactatgaattctgggaaaggtaaggagataaaaaaataaggtttttattcgagggccaaatgaaggccctggggatcaaataggacccagggtggctgaggtccacgtttctggtatatgtcgcatgaaaggtgaattcccgtcttctgttcctggaggcagctggtgaaatgtagtctgaaggagccagtccctggagccagagaagactggttggaacaccagccttgccatttaccacctgaaggactttatgcctatgattcactctgtgaaccttgcggattctcttctgtaaaatgggacaacaatacctaacatataactcctgtgtgtaatggcacattgagatgtccatggttcatgaaggaagcaagttgcccgaaaatagataaagtatcatctcagatttgaaataaacaaacataaaaatagccattcagggtttctgtgtgtgtgtgtgtgtgtgtgtgtgtgtgtgtgtgtgtgtgtatgtgtgtgtgtgtagcaaaaattctagaaggaaatacatcaaaagggtaatcaactgggcagactaggattggaaatatcctaggaataggaaagagggtatatttaatatgtgcttcatttacacctatattacctttgtaataaggatactgatgatggtactattactagtacttctatgatattgaaaacagcaataacaccaacttcagaagatttgggaaggaagaaagggtagaatatatacaaattgtagtagtgagtcaaacacatagaaggtgatgaaaaattgcttttttttttttggtctctagctaattgccaagaatatgttctccctctgttggaagagtctgaggcactgggccaagataggtggaaattgactaaataatgccactttcttcttctcactcttgcctttgtcctcatatcctgaagtttcctccttactacccgtatcttcccagattatactcatttatcttccttccctggtcccatcacctggaagtagcctgtccttcctctgtcctgaagcctgctacacgcatctcttttcttatatcggtatcaccactgatgcatttgaatttagcccacactttcagaggagtcagcatgtggcaagatttagggcatgctggtgtctcatctacctagggagagagtgagttttctaaggaagaatccatatctaattcatctttaaaatggcatctctaagcacagcgtttggcccttagcgtgcaatcagtaaagcattttgaatgaatgaatgaatggagtgacaaatggtgctttaaggcaactatttgcagaatattgccatagatgttatcaaacggaaacaaaagagacaaaccccacagttccctccccacactctccagtggcgcttcaggttggggtgcagtggagcaatcatctctcaatgcagccttgaactcctgggcttaagcaactgtcccacctcagcctccttagtagctgggactacaggtacatgcaacaatgcctggctaacttttaaattttttgtagagatgaggtattcctatgttgcccaggttggtcttgaacacctgaactcaagcaatcctcctgtcttggcctcctaaagtgttgggattgcaggtgtgagccaccatgctgagcctttttttaaatgtgaagtttctgacatagaaaataggttgggttctattttcagttggaaccaatggtctagcaaatgatgagctaaactatgggatacataggacatttggagtgtatttatgcttttgctatcaaacctaattgtcctttctgaggtgctaatatctggaagagcacagctaaatagccaaaccatggtttatgaatccagaccaaaccccatggggcattcttggggtttacacaacaggaatgggcatgcgcagagaccctataaaagatcaaacaaagttaacatcatctcgctctttcaaaaaactagtcaactgctattctttgttgttgtcaaattcatttagatgaggaagtctttctgttttttataaacagagagtccagggtaatgtttaatagcagaaatacagagcgaggcagctggtattcacgttctggccatgccactaactaaccaaatgataatgatccagttaaatgggccttggttcctcagctataaaaatttggataacaatctcacaggaatgtgggaggtaatacatgtaaattaaatttcccttgtttcagattactcacttttagtataaacgaggtaatagatgtaaagtgcttaaaactgcacccgacacataataaatgctggataaatattagctattcttacactatttctacctacatatatttgatagttctactgtgaaataaaagaaaatgttgccttgttcaaatacagtttcgcaaaaacaaacacaataaccaagactcctgcttgaacaacatattagctttggatatagcagtgtaatcaaaagcccattctgtgactcatttctactttcctaattgcctgttcctgctctggtcctcagccaggagtcagtctttagccacacatggatatatacacatcagattgtgtgtgtgcataaacaagaacacacaactcctgctgcctctgaggactgcaaagaaatgacattaaaagtgagtgatttgaaacaactgaaatttaattaaaaacaaaattaaaagttgttccaagcctggcgcttcagccagcaagactcagaggaaattagtaagtgctactaatagctggatccaattcacaacctctatgagaagacagtcagagcaaagaagatgcataccctttagatgaaacaattaaagatcacttctgagaaatagtcatgtacagtatcccagggcaaaaaaaaaaaacaaaaaaacaaaaaacaaaaaaacaacatcatttgctgatgtgttcctctttgaattcctcatttctattaagggaaagtgccctgagattctcctagtagcatcttcaatggcaacgcactgattttgaaaactagacttaacacgggaggtgggggcaaattcctttaaaaaatgttgtcatccactgtcctgaaatttcaccttgcaaatttattcatcctttgaaattccaaatagtcaaggtgcttagtaaaatggattctcctcaaataatgaagacgattgtcagctgggagttggggactcagcagcaggatagttaaatgtgctggctgcaagagtgctatggtggatggaatcagagtgggcagtgggcagtgggcagaggggctgcgtctgagatgaatgctcagaggcaggtctgagaagaccacctgtcccgggttctcagggtagcatggagagaggtacaggagaaacagcaaaaactatgacagtaaacaggaagatagtgaaaacaaatcaaacaaacatacgacaacaacaacaacaaaactgaagacaataaatgagaggggtggggtaaaggaagggggaggaatgactaaagctgtggcattgaaagtcttcatgagcattaactggccaggagtggaatgaaccagcttagcctaaatacacaaaattggagcagacagtacaggtccctgaatcaaagaatactgctcagagctctaccttgctctactttcctccgtgtccttgtccacagaaaggaaagagaatgcccattccacagaaaagctttcctgtgctcacttctacaactcatcacccagtctgccccaaccacattgaccttgttccaccttgttcaagtcacccaaatggttttgactgtgttgtttcctctgcctggaacacactttcctctaccacacaacttcacatgttcctttaaatgtcgttttctcagagagatcttccctgaccagcatatctgagccttctatcccaactctcctctattttaattattttacaccattttaattatcctcacagccactctcacctgttgccaatgcttacttactttattttgctaatttgctttggtgttcgtctcctgctgagaatgaaagcatgctgcaggcaggggctgtgtcttttccagcacagcatcttgactgccccatgacacataagaaacaggaaataaatatttgttcaatgaatgaataaattctgtaaagattaaaaaaggtattataggtagaatacctagcatactgcctggcacatgatgaattctagctgttattttcataaggatctaatattatatggatttgcattctagtggtgaggttgtttccggaaggagagaaggatggggactgaaataggactggaggcctctagatgccaacttgctgtcctcacactgtgtttggaacatgcaatatggcataagcacgcacctgttgtctagatggatcttactgagggtgcgaggttggggaggggatgggactgggcgctactgagggctgatgctgcaggtcaactagggagagaggagaagctgaggccaatttccttttgcacaaaccagtctcatcccatcctcaaacgagttcttcaaggtggacaatgaatctgtccaagcccaacttacccttttatgctcatctcagcttctaccttctctaagaatcttttgatgtctacctcagtgagaattaccttctctatcttctacccaactcctcatgtagctttgagagcaatgcagcttatgtttactgggctcaagactggttttgaagagtctacctcattgtcaaatcttgtgacgtaattttgggtttcaaaataaaattgcaaccaataattcaataacaggaatcataattacaggaacggtattagatgtctcagaattgtttttttttaaaaagttattgttaaaagtatcctgaatagggaacagatctaaatatactgagctcccactctatgttgaataccgtgacaaaagggggtggttataaaagtggaagaaagagtccctgcccgaaagtagtgtatggttcaattgagagatgacaagatagaccattataatagaacataatcagtgtagtgataaagataaaacaggaagctttgggcacacagagcagggatgctcacctcctctgcaaagtcagagaatgcttcctacaaacggtcacacttgagctgtcacacttccttatattgagttcaatataagaaagcagctaaatggagtagaggggtgctatgctttggctgtgtccacacccaaatctcatcttgaactgtagctcccataattcccatatgttgtgggagggacctggtgggagataattgaattatgggcagtttcccccatactgttctcatggtagtgaataagtctcatgagatctgatggttataaggggaaagccctttcatttagttctcattctctttcctgccaccatgtaagatgtgacttgctcctccttgccttctgccatgattgtgaggcctccccagccatgtggaactgtgagtcaaacctccttcctctaggattaccgagtctcgggtatatctttattagtagcgtgagaacagactaatacaagcggcaaagggatttaggcaaaaggaaagaaatgctgcaaagaaacaaaacagagtctgggccttcaggaaatagctatttcatttggcctgaggatgagatgcccaaggaggagaatgggctaagattaggctcaaaatagtttctggctctaacattctacactttagaaaactgccaactagctacttggcaatatgcccacaatgtgccctcacccctgtactcatgcccccccttttggggtagcagaagctgccatctttaattgattccacatttcaagtgtgacaccagctcccatcaccaggcctctgtatcttttttcaggcctctgcttccatagaaagtccactgcccagcacattaatgcttcatttgagtctttgcagggaatggctggccctggaaccttgaaactcataggtcatgttaacactcatgtgggtgccacagactgatcactctctcatcctccaccctggttcaaatactgcagtgagatgtcacctgagatattactccagtgattcaaaccttcaggggagcagccttcagagatccggcaaattaattttactcgcaggacacagtgacatctcctactaataacttttatccaggcagcatttgtaaaggttctaatattgtggtttttcttttttcttttcttttctttttttttttttgacagagtctcgctctgttgcccaggctggagtgcagtcgcgtgatcttggctcactgcaccctccacctcccaggttcaagtgattctcctgcctcagcctcctgagtagctggactattttttgtatttttagtagagacagggtttcactgtgttggtcaggctggtctcgaactcctgacctcaagtattctgcccacctcagcctcccaaagtgttgggattacaggcatgagccaccatgcccagcctattgtgtgttctttaaagttgcttgtatttttttcttttctttcttttttttttaaatctaaatatgtagccaagaagtaggcatctgatctttggtctcacatcgggatgctggtgcttcagcggaattgtaacagtccctagtttttgagtgtggttaccatgggccaggcccttgaaatgaacaaccatttagttctcacaataacagtctaatttctggtgttttagcatccccatttttcagaagatgaagcttagttaggatttgaacccatgtactctggcattggtgttgaagctcataaccaccacacctcacagctttacaaaaaggggattattcttacaaggcttcctcaactcaattgggcttcttatgttgattgatgtctggggtcatcaacctttcagggatcccaggtggcagatgccacatcatctttgactcttcctcttccttggtctctacttgtagttagttgctatatttcctttttctagctctacaggaactcttttttctttattttcacatttaatgcccttgttcaggcattatcttatgaactcaatatggcagcgcctatcaggttccttgtcgccagcttaggcaacctcagattcacctttcacattgtgatcagtcattaaacaaatctttattgaacactgattgtgtactggggattacaaaggaacaagacagctacactctctgccaataagggccttaaagtagctttggaaggggctattgttttccaagtatggaatatgtgctacgcaagatcaccctttaaggtggtttactgtgacattccccatttcacagatgcacaaacgaggcttagagaggttaaataacttaaggctacatagctacaaaatatcagaggcaggtatcaaactctggcagtgagattctgtagcccagactcttaaccaaattagacattgaagaagtaattgcaaatgtactgaatgcaaaaagtagtagttcaggaccatttaacaaggagactcgacttagactgaaaggacggtgatggcaattccaataaaaatgaacattaccaagtactttagaaatataatctcatttgattctcccaaccctacagattaagaaataacccagaagggttaagtaacactggtagcatctattatctattatttcatgcagctagcatttgaacctaggtatgtctgactccacagcctgaactctgaattaacaagctgccttgccctttgtaaaagcaactgtgactcttccactccttttattaaaatccttcagtgcttccataactcccaacctccaggataaaatcccaactgctcttcctgggtaaaccctcccattagatccattcatgcccccatggagccccagccttgctgggtgctacctgctcctgccacacctttgctcatgctgttctctttacctggaagattgcccttcttgtcctccctctctccccccacctccaacagaagtgcacattctcactcccaatccctgcccatccagtttcctcaaatgggaaaagatgctagcagaatcctcttgctccttgaagctttacccagatctgcccagtggaaaagactccaagcttccctgacaacctggctgactcctgtctatatgtcctgatggttcagattatcatctaccttccatagtagccttttgctatatagttatcctaacattttaaatgacacatgtgatccctgtgagggtgtgattggcattttctaaccacctatttttggctattgttatgccactctctatttcaccctcaccaccaccctgtgaagtaggggcttatagcttcactttaatagatggtaaaattggtggttctgagaagtacagtgactcgtccaagatccataattagtaagtggaggagtgtagatttaaacctgaggatttaagattccaaatcccatgttctttcccccacctcacccacctttaatgctgactgtgcctgagttaatcccagaatctaagtctggccctgagcaggcactcagcaaatgtcagctgaaagtttgaatgtacagactcactgataaagtttaaatggaagccagagttaaagccagggagtgaataaacagaaggttcaaggatggtccaggctctggggatcactccagctgatgatgagatgccccagccattagctgaggttcagaaagttgccaagagcttctggaaaacccaaggctgagcagctgcagatatatttggcttacataatccagaggaatgtgctggggagaaaagccaaatagcaaggctttgctgggtagcagcgctggggaagggggagcaggatgcacaggtgttaattattcctcccatcttatcctttcccatgtgaatacaatgcattcttcccctcccagactcccactggcatcagagatgctcaaggtccctcttcagctggggctgagaggggaagctgcggaggggccaggcttcccactactttatttttcatccaggcagccttgggagcctgaagtccctccacaagcttggatgtgatccttctaagctgtcttcaaatggcaacttgtgggctcagctgtttgctcagctgtctctgctccctacctccctgttcagggggctgcatgacagcagtttggcccaaagcagtctgaagacagagtacctgggacactaatgtgatggctgcataaggacttggaaggtcatgtccatcatgagataagtaaaaagggactttgaaccccagtatttctccctctccatttaagatactggggcagggaagaatcttaagtaccaccttgttcccctcctacattttacaatgaagaaactgaggcctgaagaagtagagatttgtccaaagatggagtgaattcatagaggagctggaggatgatcttagtcatcaaattctctatcacattctgtggatgttgattcaaaataattctgttcaacctcttcccacctgtgtaacactaagatggtcatataacctccctaggcatacatgacctttcaatttttatgtgtcccttaaatttgaggataataactggatctacttcatgaggtaatagaatgaaacaaggtaataccttgcaaagtacttagcacaggacctggcacttagcaactcttccgtaaacatttctaatcattaccagtgttattgcaaccattgggaggtttgaaaaacaggatctataggatgcactgacatgtgtccatgcccctccctgggaagcctgcaatcatccattgcccttctccagataagtgtcaatggctctaagatgtagctcaagtagcacctccttaagacaccttcttcccatctccagcttgggatacttgtgtgcccatcggtgtctccacagcatctaggacaatcccattatgaatcattcacactgagtcatcatttattgacttggcatgtcccaccaccactaagctggagaaggccggagatggtgttttatctgtctctccaccccagtatctgagcatgccacagagagtatggtatgcaaacgtttgttgaccatgggaggaaaaaaaaatgaaggagaaaaggaaggaagaaagggaagaagcagaacactatataagaataaaagagtggtgttattaatgcattttaactatctatcttccttcttctagccaagggaggccaacccccctaatattctaccttttccttacctagccttacctgccaagaccctattccaaccctaaggttttctttatacatattaaagctgcaaacagtgaggaaaagtcacaacattctcataatcataactaccctcacagttgacaaaatacttttaaatgaatcagcccactaatactctttgaaggagggagtattagcatgtttttagatttaaaaaaaacgctgaagtttaggaggggaattaatatacccaaggtcacaaaactagaaagcagatgaacaggtctggaatgcacatctcctgggccacagatcaatccacttaatgtctttaccatactaccttctttctcctgtggattactccactgcctcattatacactatttggcaaaccttaagccaataattatggaacaactaactctatagacttgaagtcaatctcatcaaagctcccacccagcattctctctttccgttctaaaagtcaaagtggccttctgttcacaacaacagaacggaattattaatgagagaaaattgagtttgcctactccttgcaacaaccctctgccccagttcctgggaacatatttttggactcaatctgctatcaaaacacagaaattagtctccaattttggacgtcaaactcagttatctcttttgttatgaaggaaaattagtaatgattcattctggttggaagccaagctaacatcttagcacagagtgtcattaaaaatcccagtcccactggctgctgtggtatctttaaaagcttgaacatgttcagctgcttagaatggtttttctgggtttgttctcccccaagccacttgtcattttaacctggggatcagttactatttaaggcagaaaatggcttaaattttttttcttccatggttttatggatttagacattcctaatgaagagatttgaagaaaaaaaaaaaagaattctactctagggggtatccacagctcccagccattgccgagcaagttggccattaagtacaagaaaaagaagaagtgaaaaaaagttttcacagtttataattatattaccaatttcattacagatctcattttaattctgactgaagcctagccttgccttctccctgtactctctcacgtatagttattaagtctgggttggagttcaagctattctccctgatttcagcatattaatatggtttattggtatttcattgccacctcccctatgggggttctgaatctcagcccaatttatatttcccctctttctgggctctgggatgaagcttgtttcattttggtgttgaggaggggtgtgtgaatttgattggagtttatttttggggatgggagcaacatccttggggagtgaagtcaatcatagaagaagaggcagcctcagacctcctgcactgtcattctttttgatgtatcttcttagggcttctgggtccaccgtcggtcctcccttacttcgttttttacagacacaatttcttatatgcctactgagtcagaatccctgttaggcatcacaataagttagaacatgaataagctgtggtccttgcccttgaaaaaatttaagtctaaccattgaattaactttacaaaaaaattcagtgaaagccttttagcgggcatcaagtatgttttggatcctgtccaaggttctgaacataatgtgcaaaacaaatgtaatctctatccttatggaacttgaaacctagcaagagagaacaacattaactagataaatttaaaattatacattgaaataaatataatacagaaaaaaagcagggctcaaggagaatgattcataagggagctaacagaggcattaccctagggtaaatgagagaaactagagatgtgggaagaagttttcaggcaaagaaaacaccatgtgcaaagggcctgaggcaggaggcaacagagaaatttaagagccaatatatggagaggtggtgtgacgtaagactggaaaggcgggcaggggcctgaccttgcaaggatgcaaaggccacaataagaagttcagtcttcaaaacaagtaaaaaagaagacaataaacagatttatggaaagtatgacacgtatgtaatacatgtatgcgatgttttgatattttcattgtaaaagatggctctgtttgcattgttaataaaagataggagagagcctagacttaaagcaggaggccagttttcaggactgtggcagttgtctcaatgacacatatgtaacagtaacagtaacagtaataggagttagactgaagtcattagaaaggcacaaatataattctaggtaatgttcatgagaggtgatattatttgtctctaaggattcattgaagaaggttttctagaggagggagcaaactaagttatgccttagagatgggtgagactgccatatatggaaatatatgatggagaggaatgtacaagcaaaggtatatagagaggcagataccaggtaggacagtctatttgtctaaacagcatcaaggctgtgcaaatgagttaacaaagaaaaagacagaagccatattgtacagaacttccacccataagcatgttccacagtattcaaagatctgcagtcaacatggagcattttaaaacaaagcctgggatgatttcatagagcaggatgtccaaggaactactcgttttaaataaagtgcttggcagtttgtggctaaggatccacttacaatgtggtgtcattttcccttctaagaattgaaaatactccttccatgtattcaaatcactgcaaactagttctgaagccaattatggacctctttcctctctaacagcacaaagtcatgcattagctcactcttctgggatggaggacatcaagtagggatgagagcaaataaatgtagacaagtgttattattcacaattttatgctcaaaaccagctacatgtgtggcatattagtgaaccatgccatcccaatgtgtgggcatttatacttgatgatttcatgggctaagaagccatactcagatcccaaatatctcagtcatagggaacagagaagacttggatatcaacttagttcaacctaaaagatgatgttaaccatttaaaataacctgaataaaaagacattttagcataggtattttgatgcaacaatcatatcaatatataaaattgtgtgtgtctgtgagtttagctaagtaacatattcaagagacacagacatcccttgttttcacccatttctgagcctacgcaaagaattggtgacactctgtgtgaagtactaaggaataaagaaacatattctaaaagtcctaaaaaattaagtggttttaaaatttacagtttgataatatggctccaaaacaaaatatcatgattcaaaccaaacgcttctcttcccctctcttctacagctttgtaaaaatgtggtcatctattctcaggagattttctatgatggggaactcattaccctgcaatgacccccttccaatattaagaaaatattattactacttctaacatttatataatttattgaaccattactaggtcttaggtattgagctaaaagctttatgagcattatttcacttattcttagcaataactttataagtactgctattatccccaatttatagataatgtaactgaagcttaaaatgtttaagtaactagcacaagtcacacagtcaacagtagaggaagacgtttccaaaccaaggcttcatcttctcccatccctgaccatactcattacccatatatctgtctagttttgcttccttaggacttccagaactagcctgctctcttcaaaataaataataattatcctggtctcctctctggaagcttagagcatagaagaaccttagactgggggctcaggtaggcttaagttttcataccacgtcatctatgtgttaatctcgtaaaaccacctagcatccctgagccccacttttcacgtacgcaaaatgaggatactaaatccagactctcaattttgctatgagaactgaaggaagaaccctgtgtaaagtgctttgtgtgctactcaatagataacagacatgctcaataatagtaggttcccttcctgtctaggttccttcaacgcttgttattgaatgaatgtcttccatcctttccttaagaggtcattaggtatctacagtgctttttcaatcttgtggctgccaaatcctctcacttgaataacttccaatgtataacaagtcttggaacaaaacagggaattctaggtggactgttacctgcctacactggagtggaaccatctcacctacttcacctagatagcttgttcctttaaaagcagactcttctattggctgaccacattgggtgaatatatgcccacttacattgggaacctcagtagatgcataaactagcatctcagctaagataggtgtttaatattaaccaataactatttctcaatgaggctaactgcatggcaattttgatgaggtccaaacctgtgtgatcagggttagtatgttataaaccttaagaatagaccactcacattatatccaatgctaatgatagttactggagttatgctatgaggcagctccattagtagggcattgataaagtcaaaggtggaggaaaccaaagacccttattaaagatgcttataatgattccaaggagtctgaagaagtgatcacatatgttagatggaaaaaaagtaacacttaaagaattattgacacagctctcgaagccttgataagtgaccacctagagagttcttgtaaagaatattaatatgtgggctctaccctcagagaatctgactcactggttctgggaattatctccccagataacctaaatgcagacgatttgtagttcacagctggataaacaacactagcttaagtctgtttagatgcaaacatgttccatttcttcagtgtgtgcttaggagggcaaaaagccactgatggctttgaagaagcccagataaaagaaggggtgagatttgccaagggtttggataggaactgtgtcagaactcttgccagctgggctctggacaagtgctatgtcataatgaccttttctttataatcgacagtaaacattgagtataactatgcagtaacacaagggcagaattcattttctcctggaagacaggacccattactcagccccatccaatgatccagcaccacggacagctcaatgtgtaatggtagctgagagctctctctactaagaagggccagcacctgggcagcttggaactcatgggggtgactgaaaaaggatgaaagctgctctggctttggtccctgggagacctggtctcaaatggagcttcttgcacttgacatgagctgccctcatcctgacagacctcattgagactttgtttttcttgttttttaaaactttgccagttttaaggggccagtattatgatgtgggtgaatacatatatgtaaaatatcatagaattgtgcactttccatctgtgtttgtcaccacatttatgttaggttgtaacacatttataaatatcaatgctaacggatgacatgggttcaagaaaataggcactattatcgctttccctctcatccccctatgtaataccctcatatctccagaaatcagagctggaaactccagtagtacaatttataaaatcaattttctagatccttctctactcctacagaagatttgattctactccccttcatatcccagtttctgtatctgccaaaggtggataataaagaccactttggagagctgttggaggaatgagatgagcagcactgatagagtttctgccaaaggaggcattgggatcatgctggggaaggtgagcttgattgggattaccagacagccatccacctggcttcaaatgctggatgctcccaggattcctgccaagccccagagatggaggagtttcaagtgttaacgtcttcaagtgggaaagtcacttttggctggaacagagcatataatgtattcccttttccattcacctcactgagagtagctaaattcacctatttagttttctatattttcttgccttgccatattccagcttctgaagtctctttctctacaaactgttttaataataagagtaataacagctaccatttgttgggctatcacaatgttttagacactctactaggcactttatacacattataacgttcaatcatcccataataatccttattttacagataggtgagaaaaatgagactcagatagctaacttgactcttctatgtttcacagtaactaagcaacaaaattgagatccaaaccaaaacttacttcatttgaaaggacacattcctaccaagatattatggcatgtaagggatggagattccattatgcctggagactaagatactgtggacaaggtcttcccaatgctgtcttctaagcttgctccatcgcatctccaggatgtgtatactccgtagttatttctctttttcttttgtattaattatattttcttattttctggatgcttgatgctctggcatctgagcctcctgactggggagaaccctcccctccaaggatagtcatatcttacagaaagcaaaagacttgtccagggagcatccctttcatatgaaaattaaccaatccagaacctacactccaatcatctcctctatatggcttatacacattgggaaggaatattctctcccttcatccccccagggccagataccaggcaatcaggagcagttctgaaaccccagagcctgctaaagttattcaaattggccaatctcaaatctgtctatcctgcttacactgcctcacccatttcttcctgcaataaccataatacaggctctttcccctgctttccacttggtccctctgcctgctgatagatacgggtgctttcccacatggtctgcatggtgtgctgtgcattgtgtatctgagatctgttagtatgaaaactgcttgtttcacaacagtcctttcggcatctgcagacaaatcctgggtacattttaaaacttcacaggtatattttaaaacatcttgatttctatgcatcatctgccttagttttccttgattcagtatctgttgtgtgcttagagatctaccagaaggattctatagaacaatgaacaactcagctttaattcaggcaacattcatccactggacacatatttgctgaatatccattatggacaaggcactgtgcttatcaatgggaatataatatttctccccaaagacataattcctgccctcacagagattccagtctagaggcagaaacagacaattccacaggctgctataaaattttaagtttatgacattgggcacaccgagaaagggcaccttttaattcaccacattttggtctatccttccaaatcatcaagacggtttgccgctgtctcgggtaatcccttgattttgctatttcccagctgttcaccatttctcagccacatgctgtctgaaaatctgatgaccatgataaaaaagtaggtgttgtagtcttcagaatactcctatgaggtaggtactactattatccacattttatagatggagagacagaggctcagagaggggaattcacttggctatcgaagaggcagacaaaggagcaagtatttagattaatgtttgtagtattccaaagcctgtgctcttagccattaaactgtttcatcttgagcaagttattttctcagggattccatttctacatgtatgaaaataaatatgtaaaacttgaaagcctttaaggcttaacattctacaattaatgtgtagtgacagctgagagatgaagggtggggacatgcattctgtagaatttaatacttgctctgttgtttttttccacctcagtgttcatcactcctactcctccattgccattttctggccacttccaggttctgacaattcttctagctgcgtaatccatcaaactatttgcttctgtaaattttgttccttctgatttcctacagctttccctgccatctcccccaccacacatttacttgtcttatgtgcacatatgactcactaaagatgagccaaagtcttgtacataggtctgaaaatcaactgaatgtaaatgaaataagagatataagttctgaatgtatatgaactgatttgcagtccaagtgaaaaacaagtaggggcttctgcactacggtgaagtgggaacaatcaggatgcattaatagaagtttgagtgtttcagagaatggtggtaaaattccacttttctctggtcaaaatatactgaagggatggtgctaagttctgaataccgaaacttaacggaaataaaatcaaatttcactgaagaaagactggcaaatagagggtaaggatctcaaaaacgttctatacatatcaaaatgcaaaatttttttaaagaattaatggtactaatatggtgctacaagtcagaaagtttattgcgtctacagagcactaactggaaggaggcacaaggaaaccatatgaggtgctggaaatattctatgattttatctgtgtagattcatatggaatcttgttacatgtccttatcacaaaaaaattatagtgagaagacacttttagaggtgatggctacgtttatggcattccttatggtgatgatttcatgggtatttacttatcttcaaactcatcgagacatatatattttaaaaagtgtaaaatgtatacaatttttaaagggtaaaaagttctaaaactaaaaatttattaagttgcacagttaaggtatgccttctttattataattatgccaaacttcaatacagctaaagacggtgatggcatgtgagaagtgtttgagaaacagacgccaacatatcctggaatgtgtaaactgggacaacttttctggagggcactttagcaatagatagtaaccaccttaatcagggtcttggaccatgctttgctaatgactatggtggcaacagtgtctcattaattcaatttaattgggtgaaaagtaaatgctagaatataagacacttgtatatttacagggaatgagcatatgaatattatccaagacattcaggaaattccaataaaactcatacagtcttccttgtcatatgattctaattagcaaatactctttggggggcatttttattttgaaatggatccacagtcataaatgtcagtaggttctctgaagtagctcaatctttctgtattcacatttgaattcttcctttatttttaaaactttatcgttgctcataagttaaaagtagtctttactggataaagaaaatgtggtacacacacaccatggaatactatgaagccataaaaaggaatgagttcatgtcctttgtagggacatggataaaactggaaaccatcatcctcaacaaactaacacaggaacagaaaaccaaacaccacatgttctcactcataagtgggagctgaacaatgagaacacatggacacagggaggggaacatcacacattggggcctgttgggggttggggagaaaggggatggagagcattagcacaaatacctgaagcatgcggggcttaaaagctagatgatgggttgataggtgcagcaaaccaccatggcacatgtatacctgtgcaacaaacctgcatgttcagcacatgtatccccaaacttagagtaaaaggaaaaaaaaattaaaaaaaataaaagcagtctttaatttaattcaaataatccagattacaaaggataagatcctcttccaaggtctttagatgctcctttttttcctcctgtaatatatgtaatagtaattctaaggtttggccatacacagaaacctttgaccagtcaggggtgcaaggtgctgagtgggtgtggagcatctgcaatgctcggctcttaccatctgctatgaagtgctcgggcacatgcagagtcaccttcacagtgagtggacaagacatctggctgccacacaccatggccaggatgcaggaactcacagcaatcagtgtcagggctgtcttgttcactgggcttttcagcaaacctggtaacaagaacatacacaaagacacaaaattccatgaggtgaggaaatgggattggcatcaagtttgggaattctattattttccagttgggaatctgaaaaaagaaaagaaaagaaaaaagacatgttttctaacctttgtgcctgctatgacacctcagtgggccttctttgggccttgatttaacactccgcaaaatgggcttcttatgattcctttgggtaagcataaaagaaacaggctttctgaaactcatggcaattttcactcctcccttcccaattcggttggtcattcttgataacaattagatgatattaagccctccattctccttagaggcaagtgagaagataccatgctgttaaattcagtagagtctagtgaaataagcatgggctttggagttagatcattctggattcaaatttgggctttggccctcattggctctgtgatctccattttccaaacctcagtttctttctttctttttcttttttgtttgaggcggagtctcgctttgtcgcccaggctagagtgcagtggcacaatctcggctcactgtaacctccgccacacgggttcaagtgattctcccacttcagcctcctgagtagctgggattacaggcacccaccaccaagcccagctaatttttgtatttttagtagagacgggttttcaccatgttggccaggctggtctggaactcctgaccacaggtgatccacccgcctcagcctcccaaagtgctgggattacaggcataagccaccacttcagtttctttatatataacacgaagataataaatatctcacagggttcttgtgacaattacacagcatgatttgtatatcatgcctgtcatttagaagagtttcacggttagaagctgatcagttcaaatgaatttcacaagcgtttactgagcagctactatgtgagacacatacagagcagaagaataatctttcctcttcaggattttataggctagggggaaaagtcaagcttatccatagctaattagattctaacacaaattgtgttacgacctagaagagagggcagagagtacggggggtggttttgcctctgaaaattaaagacaattttatggatataatacgaaaagtagattggatctgcacagctagacgacactgggccaacaaagaaattctatggaggctgtcttgagtccccgtttgtttctcattctttaggctttgttcttcaaggttttgcttaccagttttagagcaatgcctccacaatttttttttttactgctaggctcttcttttaagcaaaccttgtctctcatctcctggatatctttctgtggctatccaattagaatgtcaaatatattaataacacgttcaaaacagggtacattatcttctccttaaagcctccccctcctgagatcctcagcttattgaaagcactgccatttagactggccagaaactgagatgtcacctttgagtttctgtcttcctcctttacagcatctgaagagttgtgtagtgctatttattctatgtcctcagcattttcacctcttcccttcatctcttctattgtatgtttgcttgtgggataagggaggtgcacgcatatctgttcactgcactccctgctgaaacctctcaagctgttttacagcatctggttgcaggatgtgatccatattcattagactggcatccaaggcctttcatgaagactcccaacactcatacctcctgtgctctggcctaaagactagcagggctgaattactgcagtgctcctaccattaacactcttcatcatgttaacattagtgcaggtgtttttccttttggatagaaatccacttgtttccttgtcaccccatcactctttgagactcaccatatataaagatttcatatgctcttggtagataaactacccatattcattgtgtttcccctcataccttattccaaacactagagtctagtaaatagacagccaactccttgaaggcaagcagcgtcttttgcttaccattatgtcccagtaaatagcacagtgactggctcattgcagaatctcagtaagtgcatgatgactcccataaatgacagtaacaatattaaaaaccaacataacatagatgctgaccaaccaaaaagcatgctagccaacatccaacactggccatacaacagaacatcggctattattctgttgtaacattggattacaacagaacaagaaccgttacaacagcccgttggggtattgcctgtatggaaatctatttttcttaataaacagtgacctgcttgaaggagaagatcccaccttcatcatctttgtgtttcttatgccaaaatcaccacctggaacccagaagttacttaatttaagaacaagacccttgtcttttttctcagtcctaggacaatgcatggcttatggtaggaactatacatgagattgtggttattgtagttttagaataaatgttaaatagaagagtaaattaaattacataaaaaggtgattccagtgtccaaagatggggaatctctaaaacctaaaataactacagagaaaaatgaacatgattatctcttattcgagtgctgcaagaagctgtttcatacatatttataatatttataaatataaatagataaaatatgtatagtataaatcttttagcaactaaatagcataaacaatctaacatcaacgttatctactaaaaagaatatggaccaggggttggcaccttgcattgacctcaccttaaaacgtcaacctattaccccaccctaatcatttagcaaaacccctacaataacacttaacagcagcactggagttttttgttgttgttgttttttgttttgcttgtttgcttgttttgagatggagtctccctttgttgcccaggctggagtgtggtggcgcaatctcagctcattgcaatttccgcctcctgggttcaagtgattctcctgcctcagcctcccaagtagctagggttataggcacacaccaccacacccagctaatttttgtatttttagtagagacagtgtttcaccatgttggccaggctggtcttgaactcctgacctcaggtgatccaccgacctcagcctcccaaactgctgggattacaggcacgaaccaccatgcctggccagcattgagttttttatctagattttatggagtctattctgggggaaaaatatgtaatgataagtctagcatgaataaatgcttgggaagatgagacaggtccagaggacaagatgtgaaaggtagtgagaggcccctggcattgggaaatggacactctggacagtgagtcatggataatagcaccctgtggatcccttagaaggcatatctcattcctggcccacacagcagcaaccagcctatgtggccaagatctttctttcactaattaacaaactaccagaaatacactaccccggctccacagggctaatttttggtctggggaaagaaggctgaggggcacaggtagaatggctcatactctctccctgggccctgctggactaaattgtgtctcctatgtcatttaaaacatcacagtaacccacggcctttaagagtcaacatgatggctgggcacagtggctcacgcctataatcccagcactttgggagacaaggcaggcagatcacctgagatcaggagttcaagaccagcctggccaacacggcaaaaccccgtctctactaaaaatacaaaaatgagccgggcatggtggcaggtgcctgtagtcccagctactccagaggctgaggcacgagaatcgcttgaacccaggaggtggaggttgcaatgagctgagatcgcaccattgcactccagcttgggccacagagcaagactctgtctcaaaaaaaaaaaaaaaagaaaagaaaagaaaaaagaaaaaacaaagagtcaacatgggaagtgaattcacattagtttattggctgttagttttctcacctagaaaatagtaacacaacttagccatcaggggtgttgtaagaacaaaatgggtcaatatgtgtctaatgccaagcaaagatttggcacatagtaggcccttggtaaataatttccaaaagaaatagtggtgtttgtctcatcattgatgacagaaactaggaatcatctatttgtccaacacattctcagaacatattaggaactcaattattcttatagaagcagaagacaaaaagagtaaaaagtgtagagaaggacataagaaggagaaagtgggagttggggtgagaatgaacagcattgtggggccccatttactcggcgaatgcctgaatcaccacagttgtttccgaagtccaggaggatgaaagcatgcaggtcaagccttcactaagccagatgcccatggagcagcagaggggtgtggggagttgccatggcaaccggacctggcagaaacttcacagtgggactcaaatcaaggtaacttcctaagagttcctggctcagggaggtgagcatagcatttagtaagtaagggttgtagacagccctgaggtggaaactatctctcccataatactcacaccctcccaaagcaggcttcttactgcactgctgttgtaagatgcagagacagaaaagggaacctccacttgctgagtgattactatgatccaggcactgtgcctagcacttatccttctttccatccatccattcatttacgaatccagccgatttttattgaacatcaagtcttttgaggcacactggtctgggcatggggaaaataatactaaacaaaacagcgaaagcccttgaagcttacatgttagtggcaaagaattatctcattgaatcctctcagctaagtgtctccatcatttccattttacagagagtagaagtgtagagcaattaaatgacttgtgtaaggatcacccaattttgtatgttacagagattggatgagaactagtcctgttccagcctttcccctgtatcactacaacttcccactttatcatggaataaggtcccaggataccctcatgtagaaagtgtggcctttggggtcaggcatatctatgttcaaatcctggcttacccacaaaatctctgtgtgacactagccaactgatccataagtctaataagaaaaaaatatttccatctgaaaaatgggaacagtggtcttttttcagagctgatgtgaggacagaataagatatcccatgtaattagcaaaaaaaaaaaaaaaaagagctaaataaattaaatgatagctgcagatcatattgcctgagtatttttttttttccagaaggctgaggtcacagttctccctgattcacatccccatttgcagttccttccccattacttgcaggggaataagctgtgctgtaggaatagcattccacccgggcatattgattgctgggactggagaaaattaataatctaattttccttccattttccctccctcttacacctcagctcctctcatggcagcagagaatggcataaaatgcattgcttaagaaattcgaccggaaataactcagtgttgttgatccacacattgcctataatttggggtttgattgattcttgctttggaaatgccaggttgagaggagaaaatgaaatttaagttaaatttggaattgaatcaatcacattttataatgaaaaaatagatctaaccccatcagacccttgtgtgtggaaaacttaaagctggtacactcccattgacttcctcctgagatccccaaagcatgagagaccaggtcctaggctgagaagtaatttatttcttagagtggcaaatggtgttgtggtgggggaaagggattctagaaactggagacattagggtgaagaagcccagcaggtagaaaggccacttaggatggggaaagaggctgggcttttgtatgtatgtatgtatgtatgtatgtacgtacgtacgtatgtatgtatgtatgtatgtatgtatgtatgtagtctcactctgtcacccaggctggagtgcagtggtgtgatcttggctcactgcaacctctgcctcccaggttcaagcaattctcctgtctcagcctcccaagtggctgggactataggcaaacgccaccacacctggctaatttttgtatttttagtagaggcagggtttcaccatgttggccaggctagtcttgaactcctgacctcaggtgatctgcctgcctcagcctcccaatgtgctaggattataggcatgagccaccgtgcccggactgagctttggttttagatgtggatatctaaatccaaagtcttccatttgatacctgcctaagttctggcaagtgatgtaagctctcagagcttcagttttcctaatctaaaaaagggtagtgataatccctaactgataaagaagctgtgtgttttaaataggagatcataattacagcactaagcaccatgtctgacatatacttagggctctgtaagctctcaatatatttccttccatctcatttcctttaaacctccctttctaatacttggcacctacatgggcatcagcaggatatgtgatactgttgctcatgctgaaatcctaactttcacacttagctgctggcccccgtggacaagtcatgtcacatctgagactcaatgcctttaattgggaattagttcatccaataaatagctatttaaggtgcaagtactgtatgccagacctcatattttatgctctcctatttccagtgcctatagcatgcctgaatatagtaggtgctcaataaacatctattgaatgaatgaatgagtgaatgcttaaatgttgtttccctttctaccaacagatgtcagtattggaatgctgctattggtatttttttctagcaaactgattcactcacttttcctggcaaggtttggttcctgcctggtcagaaatcatacaaaaacacccttgcagaggccgccaatctgcctgcatatcagggtgaccactgtagattgctgagtgcctcattaacctcactgagtgccccatgggattcccacagcacctgagctctggtgtctctgcttctctgccatatttctggaaactgaaattgggacacgtcatctgacaagtgcaagtgtcatactggaggcagaaagaaagaatattttaaactggggctttctcagaaactgtagggtatatggccccatatcctcagcgtgtctcttatatcaggggtttccatgcactgctttagtgtgatgtctcaatatgggacatattttcctttatcttgcacaccttggtccttgtctctccccatttctccctctctatctttgtcatgaactaatctcttgtgctgtctgactacggcactctcaaatctatggtatcctttaaatgatatgttatttccccaatatcttatcatctatagatttgtccttaataagatctaggcaagtgttcatccactcttattttcatacttccagagaaagaaaactcaacccctactaagcatcagttctattctcagatagtttaatgtctaaacagcctttgaatctcactctatgagtgaacttctgctgtccaaattaaataggatatatttaatatctccttcccagggcagctattttgttaaaggtggaaattaggttgccttgagctttctttcttcaaaccaaacactaataactttattttgtttctctaaagtcatattttgagtccttttattgtactttgtatagatttgttttgcttaagattactttcttagtaaaggatgccataataataattgttattattattatcatcatcatcactaccactatcactagtaacatagccactaacttaggtgccagacaatagaactaaatttttgcatgcagtatctcatctaatctttacagaaacttcatgatattgtttctactatcactcacatttttcgctatgaggaaactgaggccatcacttgccaaagaacatgcagcttaaaggtaatagggctgaaatgaaaaaccatttgatgtcagggtccaagctcttaaccatcatccttcacaatatctctatcaacctgctagatgtagcctgggcagagcagaagcaacaaatttaactgctgagctgctatccgactttagcttgccctgtggacctgtgatgactctaggtgaatttgtggtggcctcattgtcccacctgataccgaccacatgtcttcaagagaacctctccccatcacaaggacaaagtttaaaatgatggaagaaaatgagaagggctgtcgctcctcctttctcagccccagaaaatactatgggcctgaagcagctcactgtgctacttggagccaaatgattattgacaaagccactggggaacacctttggctagctctggtcctgggacaaagaccgtttctatagtgcaggcctagattgtggctgcctggtgaagttaaagccactggcagctgacatggaatggggctacaaacggctggctatttgaatttctctgtggcaactgcaggtagctgggcttgcaagtgcaaaggtcactacaaggtgttgacaatggtgttagagatgaagatgatagagatggtaccgtattattttagcttttattaggttacagattattctcaaatatctcattacctcttcaaaatcctatgtagttggcattgctgttatccccaatagacaaatgagaagtgacagtcttaaaggtgaactcatgttcaaacaacagaagaataatgggcctataagccatgtctcctgacacacagctgagtgatcttttcatgtcactatgttgctagtgtgcagcctaagtcccactagctggatatgaaaacagaaatagaatctgtgcgctctgattcttcatccattgctttttttttttttttttgagacggagtcttgctctgttgccctggctggagtggagtgcaatggtgcaatctcagcacactgcaacctctacctcccaggctcaagtgattctcctccctcagcctcctgagtagctgggattataggcatgcgccactgtgcacagttaatttttatatttttagtagaggcagagtttcaccatgttgcacaggatggttattgctcttataaatgtatccaaatgcctcaaagagctagtgtagtatttcccacaaaaccagatgtatcttgaaaagaaaatatttctatgttcacaaaattttgagacatgctatattctgcatgtccctcttaaagcacccaagtatatatctggtattaaaatccctaaaagtctttgcattacattctgtttaacaggattcagccgaatgtttccctaaagtattaagacattgcagaaccaccattctgtggaacaaggtacggaaaaaacgatctagtttaataatttatacaaaggttgtaaataatattagcagagcccaataatcaactggtgcccttatgccaggcactgtgttaaagattgtatgtacattatcctatttaaacttctcaactaccttgtaaggcaggggttacccttcatttacaaataggaaaaccagatttaactggtcactgggaagaggaagaggaaggttttcatggtcagtctggtctgaaaccaatgtctgtatccttcttcttcccaagtgttagaagaaaatagaattttaaagtcacagagaatacatgcaagaatgaaaaaggtaggcacaacagatcagttcaggaggctaaagactattcaacgtatatttagcaggctgacgaaatgcattagtggaaggaaaaagatgctgtactcaatagattaaattgcagtgtgtagatgagaaatagtagagaagataattcaaagatctaaagctctagaatggctcagaaataaatgagaaagaaggagaaaggaaaggtggtggggggtttctgattcataggtgactatcaatcgactggtgctgacttacccaaaatgttaatttttaagatactgttgtctgatacccatattagccctgttagtctacaggctgtttagatgcaccaccacattcagcccacaccaccgatgaattggagggtggcaaagaagagctaaggccaagcagtgagtgctgaggaacagagcaaaagagcagccacagtttccatggctaccaaggacgatcaggaccagtcacctcccatttccatgaaaggttcatttctagctcctttgaaagtccctgttccattatcttggaagatgtcagtggactttggcccacactttgtgaaaataggagcaggagaataacattgattgtgtatttagtatttactaggcctcctgtgatggcctagtaaatactgaatacacaaccaacgttattcccctactcctgcttcctcccctgctcccagcttccatgacaatgttcctttacctacagaacttcctttatcccaaaagcccaccgtaagcaccaggcaaagctgtccttacttgacattgggggaaatggaagatcaaagggtttaattgactagtaaggaacagagctagaatatgaacagagctagaatatgaaccgagacctattgatactcaaagttctttaaaagcttcctcagctgatcctgaccctgtgaatgtatggtgtctaatggtggtcacactgcttctaaaaatagggggcattttcacatctctgtgctccctcctcctcacctctttttcctgacagtgacactgtgtcatattcctaagaaacaatagaaatgaggcttttcctgatggcccacaaaccccctactgcagttagatttgcctgtctctttccttgtgacaggtcatatgcattcccctcccccatatgttgtcctttctacttttccaacatatctaagcagaccaactttcaagatcaaagagaactcccatctcatagaagtctgccttcaccattgcaactcacaagaacccattatttctcttaaccctatctcatatattttctgttctaatttgagccacaagacctcagaatggcaaggaactaaaagagatttaactacaacaagtcacacaatgcattgttgtgtgactgactccctctataatcattcagcctgcatttgagtgtcacctaaacttggagcttattaactaaaaaaaaaatgatgatgataaccctttctctttttttgagcacttactatgccggatacattgtgctaaatattttacagatattattttatttgattaatcataaaagcttgctagttcctagttttgcaaatcaaaaaaattgactctaactcagagttagaaagctattgagaggcaaaccaggattcaaatccagatctagatatcagagctcctaacagtattactatgtagtctctcttccctggtagcaatcagcataagaactacatcaatgccaaaagaaaatctattcctacaactataaccagctgaacatattcctgtcctcaagagttctaaaaactggcccccaccccttctctccaaggtacccctttggttctaaaaatggaaaatatgttgcccatcattcttttatttcaaagacagattctgtcatttgactctcacatgaggaaaatagacacagagccaggaaaaacggagctggaagaaccccttttgattagttggcctaatccaccatgctgaaggttaggaagagggcaggaggacagccacgttcacagtcagattgcccagagccagtcctgggttccatctaccccagcttccatgacaatgttcaccatttggggtagttgttgctgtttttgttgtttcctaccttaaccaatacctcctggaaaaaagaggtattggtataaaaataaaccatacccaaacattcccacaacatgaccttaataagctggtgcacagtagattatggcagaggaaagaaaattgactttagaattagagaaacttaggttcaaatctcagctctgtcatgctttggttgaccttcagtaagtcccattttcttcatctgtaaaatgggaataacatctactccacagcatcattagaaagattaaatagtggctgggcatggtggctcatgcctgtaatcccagcactttgggaggctgaggtgggcggatcatgaggtcaggagattgagaccgtcctggctaacgtggtgaaaccccgtctttactaaaaatacaaaaaattagccaggcgtggtggtgggcacctgtagtcccagcctctcaggagcctgaggcaggagaatggtgtgaacccaggaggcggagcttgcagtgagctatcacaccactgcactccagcctgggcgagagagagactccatcttaaaaaaaaaaaaaaaaagaaagaaagattaaataattaaatagcatgacatgcactgcatagcagaagctcagtgaatagtaaatttcatcgtcatcatcatcaacaaatttaagaccaatacatataaattctgttgtttgcactcaagagaccacttataaaaactcaggatgggtcagaaataggagacagaccatgtagactggaggatagtgagtttacagtaaggaaaggtccaaacacatgcagagcacctactatatgcgaagcctctgctgggtttttgcacctgttatttacattgtttctcatagcaacctttaggtcttcattttataaatcagaaaaccagctcagggaagagaagtgctttgctcaaggtcatacgcctagtaagctgtagagctggtcatgcgattcaaaactgtgtgatgttctaaacagaatatagacaggtggaccatgttccaaagagaataaccaggattggactggatatcatgccaggagaggacaccagatgaaggatttggggattttagctttgaagcaagaaaggctcagtcagagaggcctcttgatagggttgtcttcaaagacatccaaatatagaaagagaaaaaggaaacacatattctatatgagaagctattgtgaaccaagcctcaaaacctaggcacttgatgtgcactgtttcacttgctccttaaaacaatcctctgtgtaggtagtggattgtgcatggtgactcaagcctgcaatcccagtgctttgtgaggccgaggcaggaagattgttagaggtcaggagtttgagactagcctgggcaacatagcaagaccccatctctacataaaacttaaaaactagctggatgtggttgtgcatacctgcagtcccaggtactcaagaggctgaggtaggaagatcgcttgagcccaggagtttgaggctgcagtacgctatgatcgtgccactgtactccagcctgggtgatagagagagaccctgtctcttgaaaaaaaaactaatgatcttctgggggtaaatagcattatgctcattttagaaatgagaaaaatgaagcctggggagatcagacacttggttcaagttgcacaagccatcaggagcactggattcaagccaggtctgtttcaccccagcaacatcctggctcttctcagttctcactggagtttgttgaccatcaagggcccttgcaggtttaagcaactctaaggaggtctggcctaaggaagcgggacccaaggttcttgctcagcacccaaaccctcattctggtaaagaaaagaattggggccttgcaggccaaagaagactctgtcctttcctggatgtagaggttcagctgcaaaccacctggagattttattagaataaacacacccatctccagatccttaaatcaaggggtcttttgtttttattttttatttttgctttctgatctattgcctactcttcagaccactaacattttagcaaaaccatgtatgcattgtgtttaaatagtcatctggagataaatagctttgcctttagtgggggaatataagagaggataaaaaaagaaaaaaaaaaaacaaaagaggagaaaatgttctgtgaagcctttttgctcaaacacatttccacatggaaatctctacccatttcaggctgacactctggtctaaacctttcaagcctgctggtttaaatatgtcacttccaaaagaacaatggcagtcttagcccaagggccattctagacccactttctgtcttggtttttagtgtcaaggaagtgcctgaaggctgtgctaagaggactatctattctgggagtctgaagcccaaacttgaatataggctctgccattactcactgtgccacctggagcaaatcccttcccctggctggacttctgtcccctgttcatcataggaagaaatccattcattcaacaaatatatattaaggacccactctgctgtgagctagggatacagagctcagagccattaaatgtttcaatgtccagtgaggtagtgggccaataaacagaggtagcagagatcagtgcagagcagcaaatccttaatccagattcaggggtcatagaatgattaccaagagctgaagcttgtaatgtgtgtaagagttagctgatgggaaaaatggggaatgtgcagttcagcagaaggaaacagcagggcactgtacatagactggagtggtgggaatttcaggtacatgctgtgcagtgtgggcagaagaagccagagagataggcagggaacagctcataaaatgtcgtagttcattgcaaggaaagtggactttctcctagatcagtggtccccaacctttttggcaccagggatcagtttcatggaacacaatttttccatggactgcaggaggtgggggagtatgatttcagaatgaaactgttccacctcagatcaagtattagttagattgtcataaggagcacaacctagaccccttgcatgcacaggttacaatagggttggtgctcctatgagaatctaacgctgcagctgatctgaaaagaggcggagcttaggctgtattgctcacttgcccaccgctcaccttctgctatgtggccaggttcctaacaggctgctgaccagtaccagtctgcagcctgggggacccctgtcctagatgatatctccagtcctttcaggccagctctgccagcactgtgcaaacctgaaacacatcttcattcatttactttgacaacaaaaatgtaagtaagtacctaaaagtgccagacattgtgttgggtgctggggatatagcaggtacttcataatcccaaagcgtgaaccattaggtatatcaagatctgaagactgggccaggtgtagaggctcatgcctgtaatcccaacactttgggaggccgaggtgagaggaccacttgagcccaggaatttgagatcaacctgagcaacatagtaacacacatattttatttaacatgcagaatatatttagtctctatatttaaaaaacataaaaaaagatctgaagacctatgaaggatgagatctacaatatctacctccagaatggaggacaaagaaagaaatctcgttgagcaaaggcaatctataagaatatcagaggatatttacacgagaggaggctgaagaacatcctggctagaattagagaacatgaaacctggtgataaatcagtcttcgagtacatggacgtgaacgagcacatgtcacctgaaatgaaagaaggattagatttggagaaaaggaaagagggcaaggggactgagggaggtagtttccaaattgttcccaatggtctttgcttcctggtatccttgtccttgtgtaaaccctagtgacttgcatatatccaatgcaagaaggtaaatgttatgcaatgccacttccaaggttaggttatgaaagactgacttccatttagctcacactctctttggctctttttactttcttgctctggtgaagccaaatgccatgttgagagtggccctatggcccacatgagaagagctgaggatggcctctggctcacggctctcaaggaacaaaatcctgacaacaaccatgtaagtaagctgggaacagatccctccccagttgaagcttgaggtgattgcagctctggttgacaacttcactgcagtctccttcgaagccctgagctgggggactgatgatattgtgcctgatccctgccccacagaaactgttagataatgaatgtttgttgttttaaattccaatttgagggtgatttcttacacagcaatagataactactaccagtacctacttaaatggatagctgaaagaggctgatgagcctccattcctagcaggatatcagaaaccttcaagtttagaagagacttccattcatctagaaaacatttcccacacacatggtatgtgccagaccctgggcaactcatagaacttgcaaaagagccaggcacagctctgccttgaaggagccacagagagacaagtgagaaggtcaggtggagacatcataattacactgtgtcaggatacatgcttggctattttactgaagacttcacaagcttattaagagctgagagaaaagagccactgaagtttgcttaatgaaatccaggtcagcttcacacaggaggcagcaggcaagctgattccttgttatctttaccaaggcacctctccctggaagcccctatgttcacacatcaaccctggaagttggtgaaatgaaaggcttgtgagctctacaatcagacaaataaagtttgaaactcagctcaataatttcttaacactgtgaatttaggaagtcaataagaaggaacagctaagaacatgattagagtcgcacagggctaagagtaagcaacagagctatccattactagttgagaatgctgatacaaggaatcacgtctttcaaagcctcatatccccatatgtaaaacagaactaataaaatattgacttcacaagattacttaagttaaagcaagaagtttttaacatagtggatgataataagaaaggcttgataattatcagctctttttgttggaacagttacttaatttctttatgcatgtaaagccttttagtatattgcttaatatagagttctcagtgactgttagttgctatgattattaacagcagagaccatagacccagtgaattatcatggttcctcctagcctaagggctggccagcaatgatacatctaagttatatatccctgtgcatttataaaaatgcttcctaccccacccccagggactctcagctccttgcgctgaaatggaaggccacagattatttctgcagcaggagctgtgccaaggcatcattaaggtagagatgacagagacagggtagtggtggttccctaagtaactataactcaggtgctacacacacctggcgcttcctgcatatgctgttaaatttatgggacagcaataatagtaacaacattagcacaaatttatttgtaaaatgcccacacctgaacagcttgaagagctaaaatagaaaccctactaaattttatagaaatctatgtatatatgtgaagatgtgaagatgtgtgtaagtgtataagaattgagatcaggatgtagctgtgcttagagtagaagtaacagcagccctgggaatcataactatgattttcttcttccatttcgatcatcgactagaccagtattattagccatgttgctgccttcttggttttccagtagtcagcagctcgaggcaagaaaaagtgccattgcaaaagccagcaggattcaaattcccaaatttatcagtctctggttacacgaacttaggctggtcatttctgtttttgtagtatcaggttcctccaaagataaaataggcataactataacttagtcctactccatgtctagtgtggaagagaggcactccctcccacctctctttcttcataaagggcaaaacatatgaaagtatgttgtttttatagtctaatttcccagttgattatttgtaaagtttatttagcaaagtattataaccaggtagagagggatacagaacttgcccccctgccatgttactccacgttcctcaggggcatggacccttattattttctctaacaccaaacctggtattgagtatcagctaaattaatatttgataaaagaataaatggataaatgaatgaatggacagaggctttaaccaattccttatttgagaaaaagggaacaggcttcatgggatcatcctaaggcaggaaaataaaatccagtcattaccttctcagtgcagagaacaagatgggcaagagtttcagctgaagtattcccttgtttcacaataaaaataatgacagctaccatatttaagcacttactctgccctgagccctggattaagtcctttgcagggaatattatcatttcatatttacatcaaacctatggagttatagttactatgcccattttacagaggagaaacttaagttaatataaatgaaatttgtgtctgttatcacacaactaataaaattttaacccaagatatctgaccccaaggtatagcctctgaaactgtatctatactgcctcctaggtgactgcagagatgcatctttctgagcattggagacttccagatgtaacagaaattgagccagatactgctaggcacagggagctgaaacagaaacagacatggacgccatcctcatgaagtttccagtctggtggggatgggagatcagacatgaaaatgctagtgtacagaagaatagggggacatgagtgagtataccagaaagacctttttcagaaaggggcatttaagccctgtcctggtgggagaaaggatattccaatgtaaaatgcactgaaaaaggcagtgagtgacatgagatggggctggagaggtaagcaaaggcatgcaaaacgttgaaggccagttaatgagtttgatcttaattatgaaagagcagagaaatcagtgaaggtggcataatgaggcaacgtgttataatgcccggtctatctgctaagggagaagggtatcctgccagagtgatggtaaggaacaaggagtcatggcttgaatagtggtgacactggggatggagagagtcatcaaatgcagagtacagttggggatggaattgctggacttgtgatgaatcagatcttctaggaagtagaaaagggagaggataggtggtgtcttgacatctgtatccaaactttactcccagacagaatgtcttcaacaggtcatcttactgccatggggaagtacagataaaaacacagaataggccaggcgtggtggctcatgcctgtaatcccagcactttgggaggccaaggtgggcgaatcacgaggtcaggagttcgagagcagcctgaccaacatggtgaaaccccatctctactaaaaatacaaaaaattagctgggcatggtgatgcacgcctgtaatcccagctactaagtaggctgaggcaggataattgcttgaacctgggaggtggaggttgcagtgagccgagatcatgccactgcactccagcttgggtgacaaagagagattatgtttttttattattactattaaaaaaacaaacaaacaaaaaccccaccaccaccaccaacaaaaaaacacagactaacctagtaagataattttgtgtccttcttaattcagggctgaagacagtatttcccattcttcactccagttttgattagtcattatcattcaattgtttacttattctctaatcaacaaatacttataaagtttccatatttcctgtatgggccaaactgggcattggagatacagggaaagacaagaccgcaattcctaagtgatgcatcctggtttatctttgggatgggaacagtggtttcctagaactgactccagctggctcacaagatccaattgttaaatatttagggatgttgcatggcagttgttaaatgcagtggcttgaaattagacgtgataggtcaggcgtggtggctcatgcctgtaatcccagcactttgcgaggccaaggcgagcagatggcttgaggacagaagtttgagaccagcctggctaacatggtgaaaccccatctctactaaaaatacaaaaattagccaggcatggtggtgtgcacttgcagttccagctacctgggaggctgaggcacaagaattgcttgaacctgggaggtggagtttacagtgggccaagattgtgccactgcactccaacctgggcaaaagagcaagactctgtcaaaaaagaaaaaagaaagaaagaaagaaagaaagagagaaagaaagaaagaaagaaagaaagaaagaaagaaagaaagaaagaaagaaagaaagaaagaaagaaggaaaggaaggaaggaaggaagagagagagagaaagaaagaaagaaaggaaggaaggaaggaaggaaggaaggaatgaaagaaagaaagaaagaaagaaaggaaggaaggaaggaaggaaggaaagaaagaaagaaagaaaaagaaagaaagagggagggagggaaagaaggcaggaaggaaggaaggaaggaagggcgggccaggggcagtggctcacacctgtaatctcagcactttgggaggctgaggtgggcggatcacgaggtcaggagatcgagatcatcctggctaacatggtgaaaccccgtctccactaaaaatacaaaaaaaattagccgggtgtgatggcaggcacctgtagtcccagctactcgggaggctgaggcagaagaatagcatgaacccaggaggtggagcttgcagtgagccaagattgtgccactgcactccagactgggtgacagagcgagagtccgtcaaaaagaaagggaaaagaaaagaaaaaaaagaaagaaaaaataaagtagacacgatagaatttacactaggaaaattggcaaatactacaaatcaggttttttgttttgtttttcagagtcagtttaccagcataccactgggttggaatcatggggctgaaagcctaatggtttgtcttccaagttcaaggaaggcagaaatacaaacagaaagttaggtcacagttacaaactatacaccagtcttttatttatttatttatttatttatttatttatttatttatttattttaaagaatgccaagaattgcaggggcaggttgtagactttggagtcagacagatctgggtttgtatcctgtggccagcactcaatgatgatccaaattgggcaattcactttaccattcttatcctaatttttttgcctttgacatggagataatgtttacaaatcatgatgtaagtgctttgcacagtgcctattattaatgttgctctttttttcctccattttttttaatggaaagatatgccttcaaaaatctgctttgctgatgtgtagttcagttttattatatcaaacttttacataggctcatcaggaagaggactcctgtctgtttccaggtgctcttttagcacacagataatttagactcatctttaaacgtccagcttaagccctcaacacgtgggagggagtcaaatcctgaagttagtgggaggccataaatcgtgtataacaaatgcacaatatctttgttatacaagttattaatgtcagtctgggctgtggcctgtttacattctctgaacaaggagataaatcatcacccttgaactttcaatgggagactgaagagggagagaaggctctcaattcagttcttcaaagactttctaatcctcatacaaggagagaaggaggaagaaaaggggagagttggaaaaaaatcaagaaaggaagagaggagggaaggaaatacttggaaacctaccatatgccacatagtatagtcatttgttgcccacattattttgtttaaacctcattacaacactgtccatacttctacagatcaagataaggtgctcaaggaaactgagttacctgcccaaggccatatagctggtaagtggtggagctgggatctcacgcaaggtttgaatttgaaggatgggtcttctcctgtaccacacgatgaattatgtacaacgaggggcatgactttatttgaggggccaactccagcaggattggccctaaattgaggcagccaagtgggccggcctgccctcaacactgtaaccatggatttatcaaggtcagccacctcagccaaactacctgatccagtcaccattagaggatcttctcacctcacacaagaatagggccacaactatctctagacagccaccactcacaacacttaggacctaaaaaggagctttttcccccaatagccccttaaccttattgagcaagtgcaactttctgttgctccctggctcagaattccctatgagacatgttaaaaatacagtgctttgggccctgtgtaagacctactgaacaggaatctctgggagtggggtttagaaatctgatttttaaacattttttttcctggaaatgttaactattattcctgcagatggagaatcagagaaaggttttttaaaaaccacagtgataatccatgcattcaatacaatctgcaacaagcccttagccatgcccttgagtgcctatgggtgctgatgccttcagagcaatggtaatggtgtaagtgagtgtgtgtacacactcatgtatgtgtgcacttttctagcatactatatagaaatacagaagacatttctttaaaattaagtgtaaagcacatatttatgtctagtgaaaggaatactgttcatatttcttatatatagcaggttaattaggcttgtagataagactagaaacttattcataaccatatcaatacgcaggaagactaaggatacagaaaactttttaaggggctagccttggctccagactaccacttttactgttgccatacctccaccagagcagagattaggtagaatattgtgtgctagcctcggaagctaaccaacctgttgtattctcttacttcaagtgcattccagattaaggacaactttttctggaacagtcttggaatccaaccacattaatgtagattttcattatatacttactatgtcaggtatagttacagttaaaatatattccatggtaatatgttaactagagcaattcttagacacagtttataattttgtccttcataaggtacatttcttcagggtaaagaaccatttggggctcatctgaacacctggtgatatggtttgactctgtgtccccacccaaatctcacttgaactgtactcccataattcccatgtattacgggagggacccagtgggagataattgaatcacgggggtgatttctcccatgttgtcttcatgctagtgaataaatctcatgagatctgatggtttgataaggggaaacccatttcgcttggctctcattctctctcttgcctgctgcaatataagacgtgcctttcaccttccaccatgactgtgaggcctccccagccacatggaactgtaagtccaattaaaccctttttcctgtataaattaccaagtctagggtatatctttatcagcagtgtgaaaacagactaatacacctggttatctaggacagtattgcaatgcttttagtccactagaaggtaaatcaacttttgtgggctagcctgggaacactgcccttgagcatatgtttgcttttataagaaagcacagcctatatgccaaatggtcttacaaataaattgctagcaagccagtgggctcctaggttggggtcctaagggttgtagcaaaaccttactggggtgttgtgagccacaggaccacaagtgctagatgaaagcagagctagccgagagctataaatagtgtgccaagtgaccctaacaagctctcctatccactggggctgctccaacagctttctcttttggatacatgaaagcagctgaaagattgttttcccgagagctttttggctgccctgagcatgtcaagggactttgctgtttctaattatctccctttatgttctggccgagacttgttaatacaataaaccggtgtttccaggacgcgctcacaacgcagaaacatctcaaggtgttttacaagcagaagatcatgttaaatcaaatcaaataccaattaaagattaacagtggtgttagagagctgttatcacggtccagccagggccgctgggatggccagtgcttcctccaagctgctgcagtccagcttccagccagattgctattttggtatctactgggtgtcacagtctttgcctcagctccaggattccagaatatcaacactggaaaaatgttaaaggtcttcgcagatgatccctgttgtatcaaatggggaaactgggatttggagagaagggatgacccaacatcacccaatgttaagaatccaaacttctcaacatagaatgcctttggcagcaacgtaaatggaactggaggccattatcctaaatgaaataacgcagaaatagaaagtcaaatacttcctcttctcacttataagtgggagctaaacaatgtgtacccatggacatatagagtggaataatagacattggagactccaaaaagtaggagggtcggggggaagggatgagaaattacatgttgggtacaatgcacatgatccaggtgatgcatacactaaaagcttaagctttaccacaatctatccatgtcataaaactgtacatgtaacccctagatctatatacttaaaaaaaaaaatccaagatttttgagctactctcaagcacgcctagtcactggccccacctagatgctttcaactgctgtttctctgctgtctgcttgtggtgggttgaattgtggctattacaagacatgtctacctggaacctcagaattgaccttacatggaaaaaagggtctttgcagatgcatttaagttcaggatctctagatgagatcatactctgtttaggataggccctaaagccaatgattggtgtccttataagagaaaaacagaggaggatgtgaggaaaacagggattggagcaatgcacatacaggactaggaacttcgaggattgctgacagctccaggaggctaggaggaagccacggaacagaacagattctccctccgtgcttccagaagaaacccacactggaataccttgattttggaattctggcctcaaaaactgagagagaataactttctgttattttaagccaccaagttttggtaatttgttacagcagccacagaaaactaatatccccctcctggagtgcctttcctcacatcctgcacatggtgagaacttacctttttttcgagactcagtattagtatagcctccagcctgtgtggaagcactcttgactgaacccatgagctggatttgcacaaacctctttgatgttcttaagtgtgtatatctccatcaagttcatttcagcatctgtaactcattttttagttacctgtctctctcccctaccagaatttagagtttgcctggagtgtagaccatctgtgactcagttcagagtactagagccaatcatacatttggtccatacaggtgttgaggaaatgtctgttgaataaacatgagtataaacaagtgacctaatccttgtactcttacttctttgtcaattatagaacccacagccactgcatctctatgcctatctatcaacctttcctttcccctaacttgaagtctattaaagagactcaggttttcaggcccagatgtgaggtggtataatatcaaaaataaaagcaccagctttggggtcaaataggcatatgctctgattctgtcactttcttcgtaagtatcttaatgtctttgaacctcatctttaaaatgtaggtagaagattaaatgagataatgcatgtaatatggtcaattactcctctcagaagtaccatcactcccattttatcttttttttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatacatgtccctacaaaggacatgaactcaacatttcttatggctgcatagtattccatggtgtatatgtgccacattttcttaatccagtctatcattgttggacatttgggttggttccaagtctttgctattgtgaataatgctgcaataaacatacgtgtgcatgtgtctttatactagcatgacttatagtcatttgggtatatacccagtaatgggatggctgggtcaaatggtatttctagttctagatccctgaggaattgccacactgacttccacaatggttgaactagtttacagtaccaccaacagtataaaagtgttcctatttctccacatcctctccagcacctgttgtttcctgactttttaatgattgccattctaactggtgtgagatggttttgatttgcatttctctgatagccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatgttgattcttcctactcatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatgctgagactttgctgaagttgcttatcagcttaaggagattttgggctgagacagtggggttttctagatatacaatcatgtcgtctgcaaacagggacaatttgacttcctcttttcctaattgaagaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttcgcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtcgaaaattctcttttttggttgtgcctctgcctggctttggtatcagaatgatgctggcctcataaaatgcgttagggaggattccctctttttctattgattggaatagtttcagaaggaatggtaccagttcctccttgtacctctggtagaattcggctgtgaatccatctggtcctggactctttttggttggtaaagtattgattattgccacaatttcagctcctgttattggtctattcagagattcaacttcttcctggtttagtcttgggagagtgtatgtgtcgaggaatttatccatttcttctagattttctagtttatttgcgtacaggtgtttgtagtattctctgatggtagtttgtatttctgtgggatcggtggtgatatcccctttatcatttcttattgtgtctatttgattcttctctctttttttctttattagtcttgctagcggtctatcaattttgttgatcctttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcactcaggagcaggttgttcagtttccatgtagttgagcggctttgagtgagattcttaatcctgagttctagtttgattgccctgtggtctgagagatagtttgttataatttctgttcttttacatttgctgaggagagctttacttccaagtatgtgatcaattttggaataggtgtggtgtggtgctgaaaaaaatgtatattctgttgatttggggtggagagttctgtagatgtctattaggtccgcttggtgcagagatgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagaatttagtccatttacacttaaagttaatattgttatgtgtgagtttgatcctgtcattatgatgttagctggtgattttgctcgttagttgatgcagtttcttcctagtctcgatggtctttacattttggcatgattttgcagcggctggtaccggttgttcctttccgtgtttagtgcttccttcaggagctcttttagggcaggtctggtggtgacaaaatctctcagcatttgcttgtctgtaaagtattttatttctccttcacttatgaagcttagcttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgatggcctgccttgctagattggggaagttctcctggataatatcctgcagagtgttttccaacttggttccattctccccatcactttcaggtacaccaatgagacgtagatttggtcttttcacatagtcccatatttcttggaggctttgctcatttctttttattcttttttctctaaacttcccttctcacttcatttcattcatttcatcttccattgctgacaccctttcttccagttgatcgcatcggctcctgaggcttctgcattcttcacgtagctctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttctgttgctggtgaggagctgcgttcctttggaggaggagaggcgctctgatttttagagcttccagtttttctgttctgtttttttccccatctttgtggttttatctacttttggtgtttgatgatggtgatgtacagatgggtttttggtgtggatgtcctttctgtttgttagttttccttctaatagacaggaccctcagctgcaggtctgttggaataccctgccgtgtgaggtgtcagtgtgcccctgctggggggtgcctcccagttaggctgctcgggggtcaggggtcagggacccacttgaagaggcagtctgcgggttctcagatctccagctgcgtgctgggagaaccactgctcccttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcatggtgcgccgtttcttaagccggtctgaaaagcgcaatactcgggtgggagtgacccgattttccaggtgcgtccgtcacccctttctttgactcggaaagggaactccctgaccccttgcgcttcccaggtgaggcaatgcctagccctgcttcggctcgcgcaccgtgcgcgcacccactggcctgcgcccactgtctggcactccctagtgagatgaacccggtacctcagatggaaatgcagaaatcacccgtcttctgagtcagtcacgctgggagctgagaccggagctgttcctattcggccatcttggctcctcccccactcccattttacagattaagacattgaatccaattgcacaggtagtaagtcacattgcaggacttgaaattcatacacttcaagtccatgctcttaaacactacattatgcagaattatggggcctcctacaagataccccctagtccgtttgctgagtaataaattattctatcgtttccaagaatgaagcctctttggaatagcacacatccttgaatttatcttgtttggtattccagctccttgggaggcctctaaattcatatctaatacagacttctctagtctcagctggtttgagacactgtggatcgtaatgctgagagtatgaaaacaaatgccttctgcccaaaccatcatctttcaattacaaatcactctgtcaatttgcaagtgttttggatgcgaacatcttgcagtctggcactagttagagctgagaagaaattgagagaggatacatggggagaggaagagatgaaaagaagaatgaatcaaggatagaggaaggagaaagacaatggaatcgtcaatttgaacagatgtttagaactcatctaagtcagggccctttgtagcatagttccaggggccctgatctcatggatctatgaattggaatccaaggagtggaatggtggctcctggagttgtgaaatatcatgacacaaagtccaactttatttatttatttatttttttagcagtgggtgaaactaaggtatatagaatttaagtggctcctctaacaagtgtcagcaaagtaatggcagaactaaaacctttgacttctaattcagtgctctgtagcatacaaagggttaggtatccaaacataaaagaaaacatggaggtatggacaaagagtgatttgcaggtaaggcaaaagagttaagacttcaaagaggaaaaacaagacgaagaaggaatagagatgaagagagatcaagaagatatctacaaaagagaaaaggagggatggagaacaaaaagacaggggcagagaatctgtaaaaaacagagaaagtcaaagatgatatagtgcagcacaaattcaaacaaaatgaaagagaaagactgccgaaataaaaatgcagggttagataactggttagtcgctctccgatgaaaatatctaatgcaccccccttgctggtatgcatgaggtcctggcctcttaatgagtccccaggcttcctatgaccaggcctggctgacctcccccacaactcattccgctcagcttcctgcctctaggggtgtcttctgcagggactgtcctgcttctccactccactcctggatattgcttggttcattccacctaatcctttgcaatatcatctatttcagggaatcttcccatcccctcttcctactgtccaccctccagtccaggcagggttgtgagaccctcttctggatcccacaacagcccacaaactcccattatattatttatcacaatggacggctaatctctgttttaatgttaccatttttctcccaacagactgtagatttcctagggccaggaattaggttggattcatcttgtatctccagcaattactgcagggtgaaaaatatactgttacactcaatgcatgactgatgaatgaatgaagggacaaaccactccttctctcaggagtgacaaattatgtcgacaaccactggggggtgctcttgggtaactccagcaatgggcctgggggagcaggcggtggaatttctctgttacaaacacctcagcaaagcagagaaggcaaaagtgataccaaactggagagatccttctagacttcaccaggtgaggctgagaatggaacaaagcctgccctagtggatgaaagaataaaatgaaagtcagagaaaatggactcgagtctatggaactggttagctctgtggtctgggggagtcactcatcactgaagggcagcagttcacttgattcacacaagcccaggcgatggccattattatccccggccctcacctgccgggaatagaaggatgaatgagcaagacagcgttctgttctattgaggaaaaaaaaaaagaccttaatagtacaggaatggggttatctgggattcttattctaattgccaacatttattgcatattttctatgtcaaacatgattccgagcactagcaatgcaggtctgagcaagtcactgccccatgttgcccgttctctagaggaggaggaggaggaggaatagagacgtgcaagactaaccacaattttaagaaaggaacgagggtttgatgacaaaagagatataggtaacatgccaccacagtgacatttggtctgagggatcagggaaagcttcagaaaggtggtaacatttttcccaaccagacctgctgggacatttaggttttattagacagagctgagtcaacatgatactctaggctgatggaacagcccagcatatactagcaggcgaagatgtgcagggtgtgtttgtggaagtgtgagcagaagatggaatggaagtaaaggctagagaggtggatttggctaatattaacagcaggcaggatgcgctgtcagaacagcagaagtggcaatcgttggggtggaagtggctgcagctacagggaccacagtagcagctgctttgatggtgcagggtgccaagaactatactaagggctgtgtatacaatacctctttcaatcctaactatctacgtatctatctatatattatgtaaatacacatacatatgtatatgcatgcatgtgtatatttatgtatatgcataggaatgtctattttatcaacatgtagtttttatttccatttcctaagtgaagaccatgagacacagaggggttaaataacatatccaaggtgagtaagcagcgaagtcatgatctacaccgaggtctgtaaatttccagaggcaatgcttttaaatgctatactacacctcacccactgtcaggctaagaagttgagaatttatcatgtaggccaagagggagacaccaaaggtatctaagggaataacacaatctaacaaatgttttcagaagatgactctagggccactcctgccccaacatccttgggcgatccctgccctcctatttttaatggagccccttctggggcaagaaggggtggacatggtccatttgtagcagtccccaaatctcccaaaggagtccaggatgagcccagcccctctgacaaatgctccagcctcccctagccccagggagtgatttatcagcacagcgtcagcgcctctgcccagcagcctgtgatccaaggctggcggcccaggctggggtttttaattagctgagagagggaagagtcaagccctctcagatggaaagaaagagacacaccaagaaggctcatgaatcctgaaccaaggacccatcgactagagtctggcagtggtgggcagatggaggggaagggggagggggaggaggaggagggggcaggctgattgtctttttggcaatttcatggtctcccttgttttctggtccagacactacagggagaatgggaattcagactacctttcacacaggaaaccctggagtacacccttttctagtgtgactttgtgaccagaagtcagagagcctaatatttagctccatctttgccactgaccttctatataatttgaggtaaaaattacaacttaaaagctttcaggctttggagttagacacaagcttaattctcttttccatgctgtttactaaaactgtgactcagtcaagttgcttttcctctctgtgcctcagttttctcatccatcaagtcaggacaagatctcatattgtaagggctaaatgagacagcacaggtaaattacctgtattaagaagagaggttcctccagtctcctgaagagaccttcagcaggcatcccaccatttaactccagggtcatttcagatcacaagaatcatactgaaagcctgctccataggccctggggatacagagctgagtgaagtagtctctgcccttgcaggcttcacagtctggttggaacagacaatgagatgggcagttacagagaatatgagagagagctgtgattgggggtagtagtgaattccatgctggcataaaggaagggcacctgctgagcttcgtggacacctggtaagcacgctggagtggggaatagctgaactgatttttaaagaacaagatgtcactgttgagggtgaaaaggcaagagaagattatcccagacagaggggactgcgtgattagaataagatggagcagaatgcctggcacactgtaggtcttcaaaataatttctgtcgaataaaggaaggaaagaaggaaggagaaaaagagggggggatagaagaagggagggattcatctcattgaaagtttgaggggcagagagttgagatgacactggctaagtgatttgaactttattataatgacaaggagaaaccatcagaaggtttcaacaaaaaagtgatgttttcagacgtgtgtggtagaaaggtcacttttggaagttgggatgaagaggacaagagtggggtgaaggagaccagttaggaggctgttacaataattcaggtgaaaatgacaccaacttgtctaaggcaggggcagcgggggtggagggagagagcatctcctttaatacaggatgtagtcacagaccacacctacctacctgcctcatgtggtccagccccatcaccatgacaacagcctctttaacatccctggccataaagagataacaactcttacatctgttcctggaggtcctgcctctatatttttttcctttctttttcttcttttttcccctttgattgtatctgatccagccttactgggtaattgagtgtttgagagtgaaaaattatctcagcagcttggcccttatcttgacagtgaagcagcacttttaatttaattttgttcagagacgcatgggtaacaaatttcactaatcgcccggctgttgccctctgcatggtaacgagccgtttgttaccaggcagcccagcataaatacatgtgggagagcaggcaggggagagagacagaggttgggaggaaacaagggacagacacaatcaatatgaaccaggcttgggctctgccatcaggtggagaaacagagatggaaggccaactgcattagcacagagaggagttttggcgcgagactcaatggagctcctgtccttgttctgtctcctatctgggtgaagttctgagcaagtgatttaaactttccatattttagggttcttatctgtgaggtgaggtggggatgttcacaatctctacttctctgggttgttgtaagagttaaatgaggagctataaagtaagtaagctataaggtaagtaagctataaagtaagtaaggagctggccgggtgcggtagctcatgcttgtaatcccagcactttgggaggctgaggcgggtaaatcacttaagcccaggagttcaagaccagcctgggcaacatggtgaaagcccatctctacttaaaatacaaaaattaggaagccatggtggcaagcacctgtaattccagctacttgggaggctgaggcaagagaatcgcttgaacctggcagatggaggctgcagtgagctaagatagtgccactgcactccagcctgggtgacagagcaagactctgtctaaataacaacaacaacaacaaaacaaaaacagtatccctaaaaacaatgtcatgatattcttgaggctgctaaggaccttaaaggaaaaaaaaccctggcccttcatccaatgtttggatttctttcagaacatcctccacaggttattgttcaaattttgcttgcattcatctaatgatggggaactcactgtggaagcagacaagaactctgacactcagaattgtcttgcttatgctgacctgtaatatgcacccttcaagtcccagcctatgttagcacagccctgccttcttgacttctgtaaagagtcaatgcgcaccctccttcccaggtgagctcctcccttagacttgtatatagaaataatattgtttctcaccacacccaagtcttcttgtatccagctaaaaatatcctgtagagcatcagagctagaatagcctttataagtcatgtaacacaacattccactttatatattaggaaactgaggtccaaaaagaggaagaaaattttaaaaaataagttgttattttttgagtgcccattatgttttctccctgtttccagttttccaccattatttcgtcaggcatctgtctctatatttttatccattgaagagccatccttgatttatggtcttttgtatcccaaagccattactccaaagcacctcagccatggacatatgactcacactgcattatcttactttggttaaaaaataaaaacaaaaataccatgttattagaagcaccgaattggagaatcaggaaagacattacagaattgtagtttatttaaccagagaagaaccgaggccacagaatttaattgatctgatattctctattatttattataccctctatagcttgaaaatggctggagggcagagaccactagtcttaaccatctatgccttggttccttaaggcaatgattctcaactatggctgttcctggagagctttttattttatttttatttttattttttgagatggagtctcactctgctcctcagtctgtagtgcagtggcacgactttggctcactgcaacctccacctcccaggttcaagtgattctcctgcctcggcctcccaagtagctgggattacaggtatgggccaccatgccctgctaatttttgtatttttagtagagagggggtttcaccatattgggcaggctggtcttgaactcctgacctcaggcgatctgcctgcctcggcctcccaaagtgctgagattacaggcttgagccactgcacccggccatcaactatggttgctcctgaagagcttttaaaaagatggtcgggtgcagtgaatcacacctgtaatcccagtacattgagaggccatggcaggaggttcacttgagtccaggagtttgagaccagcctgggcaacatagtaagatcctgcctctacaaataattaaaaaattagccacgtgtggtggtgcgtgactgtggtcctagcttcttggggggctggggaaggaggattgcctgaggctgggaggtcaagtctggtgtgagctgcgatggcaccactgcactccaacctgagtgacagaatgagaccctgtcgagagagagtgagagagagacaggcagaccgaccgaccaaccagcatgcccagtctccacctaaacctattaaatcaaactctggactgaggtccaaagttaggtatttattatttaaacctaagtgtgtttaccatgcagatagggttgggaaccatgatacaaggggaaagagccctttactcacaacatcatgcttcatggacagagaaaaaggtcaggaaccttctcatggtctagaacccttttcaactggatatttacttttgatttttctttctctttcttctttgtttttcacaattaagtaaaagtgagatatattcattcctccagggattccaagaccagatacatgatggcttgaataaataataaaagggatgaacactgtttttcaagatttcaggtcaatctaattgtatcatagacaattgagagcagctgccctagttatagaaacacagtctcctcctgtataagttaaagtagtcagatctaaggctacaattgttcatcacttaccatcttctccaggacctgtgctaagtttgttgcttttattatttcattacaatcttgaaaccactcatagaagaaagagctacaagaatggccattacacagctgagaaaatcgtgggttggttagagtgacttaccaaggttcacaccgcgaggacacataactatgtgtgtctggctccaaagaccacaaattaaacactgcacattaaactacctccagcaaatccacccacctcaaatccctttcaggaacaggcagagtataaataataaacagaagggtaaatacatgcataatatataacattgtgattcacctacatatttcttttttaaatgagttgatttgtttgtccttaaaagtaattattgtggtttgtaaattctgccctccttcaaaaactcatgcttcattcacacttatctggctgtataatattctctcaagtggatgcatcatcatttacttagccatcctcctattgttggacatttgggctcattctaatttttcagtattagagattatgctacaatgactatgtttaggtttagcacttcaagaaaaatgtacagtgtcacagaaaaaatatggtaatataatgccgagtgaaaaaaaacaggagtgcaaatgtgtgaagattatggttgcaaggataagaaagagtgtgcaggaaatggggatggggaaaaaatgaaatgagctctcgaaggttttcatttatttctatttttctatgtccctttagtagaattattacattattttacattggttgaagaaaaggtaaaaacaatgagcataccaccaccaataaggttgaaacagctcaggtccacagatatccttagagcagagagatgagcttaggaatcagtggtcttgacttcttccacagacagaagcctaggaaggagcttcctaagggctggagtcatgtcttgctaacccctgacaccccagagaaccacactgttcctagaatctacaatgtgtattaaatgaataaaagcataaaatttcagagctttaagaggcctctgatgcaatttcttcaaacatcacacccaaatgtaatggatagagagccaaggggactttcccaaagctctccagcattttagctcctgaaccagagtagaggccactttttctaaagtctactccaattagaaaaggcatatggcaaatttgcccaatgggagctgtggaagaaaaatccttcgccagtgaaacacagaatgggtttgactgagtgacttggggtactgcacattgttatgcatgctgaatgccttgcattgttagttacaaatctcccctgaatccacttgtcctgcagtctctcagctgttctcatgacaaatgcccctgggctgtggcatctgttttcttcacgtggagcactagttttatttgcaccaaagatgttgagggaaggacatgttctacccagaatccataaataagaaacataccctcagccccttcactttccagtctacaccctctcctacaacagtttcctactgtcatgcctttatttacctccaggtaggaggcagaattttaaaatagcctccaacattcccaccccctgcacactgtctgtatactccccttaatgtgggtgccactgtgactatgataggatatcactccataattagattacattatatgacaagggtgaaaggatttttcaaatgtactaaaggtctcaaataagttgacaatgagtttatcagaaagaagttcatcttgggtaggcctggctgaatcaagtgagcccttaaaagagaatcgggccttgaaggaggggagtcaaagtgtgatgatctcctgctggccttgaataaacatgttgtgaaccgcctacaggggagacatgtggcaagggcttcagagcggcctctaaaatctgagaacggtccctgctgacagctggcaggaaaacaggcacatcactcatacagctacaaggaaatgaattctgccaacaaccacataagcttggaagaggattctacatgtcagctgcaatggcagtccactgaccccttgacttcagcctcttacatgatcttgagtaaagaacccagttatgccatgactggactttcacctacaaaactgggagttaataaatgcatgttctttgaagctgctatgtttctgtcaactggttactcatagaaactaatacacgaccacagagtgctgacatccacactctcccctcaactagaacactcctgagctcagatctggttggcaaatgtccccatctggatggctcacaggcacctcaaaggcagcagctccaaaatccaactagtctctttctctcctgaacacttacccttccttccttgcctggctgtgtgattctcccagtccctatgctggaaaccaatgctcactttcagcaatcttcagtggctcaccttcttggagtcagtcagtcattgggttcctctaactgtatttttaacatgttcctgtatctaaaccttcccatgctcacccagagtgttcccattctaccccaataacctcctaactagtctccctaccttcagtctcactctcttccagttctttctcttctgtagaaagtgtgatcttcctaaaacagaaatgaaataatagatcccttccttcaacagtaaatgccttcctggccgaggcaggcagatcacctgaggtcaggaattcaagaccagcctggccaacatggtgaaaccccatccctactaaaaacacaaaaaattagctgggcatggtggcacatgcctgtggttccagctactcgggaggctgaggcacgagaatcacttgaacctgagaggcagaggttgcagtgagctgagattgtgccactgcactctatcctgggtgacagagtgagactctctcaaaaaacaaaacaaagcaaacaaaaaacacccttcatagactcgtcatttcatggaggttcaagtgcaggctctttcctgctcacacagacatgccattttttagagcttggccacctctcgtccatatttcaggtataagctataatattggcttcttaaaggtatagttcatgagtctcctgattacattagttcctcttttcttttcatcagaggcagtcctcacagtttggaataatatatttattcatgtgtctatttgtgaaatacactctcccttccctttttcctctggcatgactagaaatttcataaggaaatccatcctattggtctatttcccaccatattcctggtcttcagcaaagagtctcagtggaattagatattcagtaaacattagttgattatgcaaataaaaaaaaatgaatgaacttggcattcaaagcgtttctcaatctggctaaatttatccttcccagactttttctcactgtcttccttcacataccttatattttaataacgcatgacactatttaaccatcacaaaaaccctgtgagataggattatcatttccaattttgagaggaggaaatccaggcctgggaatgtacatttacttgcccaaaatctcccaaactgacagtcaggattaaataaggttatgcatgcaagcatctcacacagctggtgacatacagagggtgcccatgaccagtggcatggtctgtttatctggaaaagagtttttcaggggtaagagaacactggccgtctcacagcgttgggaagaaaggggatgacagagtattcttgcttggggcgggaagcaaagagtcacagtctctcattctaaggaaaggcgggtgggggaatcctgctgagcctagttgaaaaacaagaaagcaagagagactgattattccttctcgctagtgtaagcaactaaaatgacatgtttgctttatcgcctttggtctcccatttgattcctgacagccatctccctcccttcgatggcgggctgtcaggtgctgagctggctggcattgcacaggaagaggagtacagagaacaatttaaacaatatttcagggaccatcatgggctggaggagggagtttttatagttagctggctttctttctgcattcaaggaaccctcatttgccaagactgcttgacgtttctgtgggtttgggtagaagtagtccagaagggatctttaagaaaaaaaaaaaaaaaagccaatgtctattttctttgaggtttgaaggaagggagagaatagagacagataggagctttttaagcccataacaatttctgaatacataattttctcttctctaatgtctcgttaaatagggccaaatgcagatgtagatcaaagctaggtttctgtattttactgcattttactgtgcttgcaagtaaagggaatccaaactcccagtttctctgtccgtgagagaaactagaatctctccagaaagcctgtataaactaccagaaccttctggaggaaggagtccactcccacaaaccacaaacagctgaacatttgagcaagagttacggtaagcaaaaatgagcaaaaacctacaaagttctcttaggggacagttctgggggattgtgaccatgaacagtctttggagccaaccgaaacccaattcaagccacagctacgcaacttattggttccattatcttgaagaagctactctgtttagtttcagttttgttcttttaaatagacacaaggacaacaattgattgctaggaagattaatgaatgtgcaatagacctgatacaaaagtgacacttaatacatagttgctataagtagttattccccttataatggttatctaagttccaggcttgggaaatggggggatacactccataggggcccaaagccaggatgggaattggaatgtgttgttggctgatatatcaaggaagcttgagagtggtggttctcgatgctggctaatattaaatgattagaatctgaaaaggatttcatacttatatccagacttttggccagacagtcctatgaaatgggttgattcttggaattggcattttaaaaagtgattctgagatttatttaggctaaagaactacccagccctgacagctcttcttcccacacagcctaggacacctgccttgatctaggtcctagaactcacgattctctcaagtaggaagcaccagagtgcccagcctcctatgcaggccctaaatattcagcttctccagctgaccttgttgtcttctgtttctgaaaaggaatcctcttccttgggccttggatgttgtagtttgctttgtgcctgccctccatgccccccacaacccttcatcatctagtgcatcatcctcggggaagattctggattgcttagactatttctagaaaatggtctttgaatcctagcctgtggctaagttcttacttcttactgacagttctccccagtggtgtgctggtaattgtttaacaatgggctctcccagcaagagcaagcagctcttttaaaatattttaagtattttccagtttccatagtttgaatctttctcctatggctgattacaagctcccaatgtggcatcactcacagcagagttgggaagagatgagtacaataggctctcgataaactgggatgggctggtccctgcacagcactggaagtcatccttgtcatacgttttcctacctgaccaaataccaggccccctttgttggtggtgccctgggacggctggtcctacggatgctgccttttgtcctccatactgaactaacttttcagtgcctgagctggttctgaccacgactatttctggtcccagcccctcccaggctacctttccccaacatctcaggggttacagagctgataccaggaagttctcagggatatgatcaggtttgctgtatcagacacagacatgggtatcctcttcctgtctctttttgagtatataccttgtgtcaggcactgttgtatgcactttacatgatttatctcattcatccttataatggcctgaccagattttgaaatcaaatagcttaaatacaaattcaagcttcccttaactcatggcagcctcaggaaagtgaaccctctcaattcttagtttcttcatctgtaaaatggagagaagaataatcccttctcctggtattgtttagaataatatgaaatcatgcatttagacaggacagaacagcatagagataattcaataaaactaatacagtttcttctgttcttttcctctatctcccttcttgttgaacccatttctattatggaccctagaatggttttattgtgaactcagagagggtcatattctaccttgctggtctacagataggaaactgaggcccaaagccttgctcaaagcctcttaaccaaacaagagacacctaggattaaaactcaagtcttggccgggtgcggtggctcacgcctgtaatcccagcactttgggaagccgaggcaggcggatcacaaggtcatgaaatcgagaccatcctggctaacatggtgaaaccccatctctactaaaaatacaaaaaattagccaaacatggtggcacgtgcctgtagtcccagctacttgggaggctgaggcaggagaatcgcttgaacacaggaggtggaggttgcagtgagctgagatcgtaccattgcactccagcttgggcaacaagagcaaaactccatctcaaaaacaaacaaacaaaaacaaaacacccaagtcttaggacttccagtgatttcatgacatcctcttgcttggctcttcctcctcctgtccctcacccagcgctttctcccctggctttccaccctgtcttcacttctcccggctttccctgtacccatgtccaggccctgtaataaccagataaacccaccccatgaaggcgctgatgcattcacctgtgggtcctctagctaaccctttttcttgagcctctagtcatgtcttcagtgggaatccctgcagggtagggagtagcaggctgatctgccccatatcttggacaccatttcctctccttaaagcctagccctctctcccatgttactctggctacaatgacttagaggctgatagaatactgcttgatctgtcttcagtgtttactctgttctgagtagcaggtcctgggggcgttctctgcaggttggcaaagggcagccagtagatctgcccatgagcaaggctacctaaatttaggcaagaagcagaggatggtgacgtgaaaagctgcatcacaatatccccaaggggctaggcctacaaaattcacattttcaagaaaaatgtttattgtttttttcttttcctttttcatttttttctttttgtttgtttgtttgtttgtttgtttgttttttgagacagggtctcactctgatgcccagtctttagtgcagaggtgcaatcatggctcactgcagccttgacctccagagctcaagcaatcctccagcctcagcctcctgagtagctgaaattaaaggcacatgccactacatctggctaatttttttgtagagatggggtttcgccatgttgcccaggctggtccggaactcccaggcttaagtaatccacccaccctggcctcccaaagtaccgagattacaggagtgagccactgcgcctggtcactattgtttttctagaaggcagattaattttcaagctggtacattagaaagaggacctggagcctgtgtggctcaggcactgatgtgctgtaactggctagcaatgaaacaattgcatggtggatgcactcggctaagcatttcctctgcttatgttatctcatttaatcctcataacaagcccaaaggagaacagaaggacaactgctacacttatcctcctttacccaagagaaactgaggtcagagaacaaatgtgtcttgccttaggttctgcaatgctaggaaatggcagagcaaagatctgaacccatgtctactgattccagtgcttatgtacaacctagaagccccattattttctgggtatattactggaaataatttcaacctgacaaagttgcaaagataagaagagtacaaagaatgcctatctatctttggcctagcttcacctgttgttaacattttgccccatttgatttgtcatttgaggagatgacatttttaaccttgaggaaaatgtttcccttctctgagccttggtttttatgtgcataaaatggaagactgaatggattacctttagagtgaaacggaaccttgttgcttgatgagaagtgatggataaaggatgaggtaagcccttggtcagtggtcaaggcacagttgctgcctctttctccggcctcattttccatcattcctgcacatgaatttgggctctactcagttctggcatctctcctccacccccttccccagtgtaccacgtaccatccgccctcacaccttggcaggtactcttccacagatgctcagctttcacttcatcccattttcatttcctggagtctctgatccattttgggactcatggcttatatttcataacaggaggcttcagttcccaaaggcctcctctgcagatatgacttgaacttttcctcacctatccttttcctcgaaaacaggattaaactgtgtgtgttggaggtgggaggagaatcataaagaaaagccatacatccacataccttagtacgaagttttgcttatggattcagtggttcttagttacagaaaatcccagcttaggaattgccaaattaaaacaagcaacaaaaacaaagaaataagacaaccagtagcattcatgctctggttctctctgctggagaactaagcagcaaagcttagaggaaagtacctgagattggggatcagaaaacctggatttctataactggctgagcaacctgcagatgagaaaagcgaggtccagagagggagacagatgcacccaaacccatacagcacagagctgggctgggaggttcatgctgggtgcctgcactgctgaaatgatccagcagctataacagctccgtctcctgctcagcattgtgcccagggctgggcaaaccacctgcacttctcatctggactttcagctgtacagaagcttatcctgattagcaacgcttccctgtgtgagtttgcacactccttgcctccggagactgtaaccactgtgaggttcggtgctgaggctccattttctcactgcccagcagcatggttattagggttgcttattccacacatacaggctaaactacaacggggctcagtcttgatgacatatgatgtaaatatccttgtatgacaataagaaagttgaggtcccgagggagcacaggcttgccaaggtcactaagctagttaatggtgaggtgtggacttgagcacacatctcctgactctgagtccaacattctttgctctatggagtactatctccgatgaatatatgttaaattcttcccactagtaacctactacattagctagtttattacttaattctgtaaaatgccatcagaattggcacacttaaaacaatgatatactggagggttatttacttgatcaaacatagaatgccttgcatgacaaatagactcttttatttattttttgtgtttttttccccattctttattattttttttcataggttattggggtacaggtggtatttggttacatgaataagttctttagtggtgatttctgagattttggttcacccatcacctgagcagtatacactgtaccctatttgtagtcttttatccctcgcccccctcccacccttccccccaagtccccaaagtccattgtattcttcttatgcctttgcgtcaccatagtttagctcccacatatcagtgagaacatatgatgtttggttttccattcctgagatacttcacttaaaataatagtctccaatctcatccaggttgtggcaaatgccgttaattcattcctttttatggtcaagtagtattccatcatgtatatatacgacagtttctttatccatttattgattgatgggcaacaaatagacttagacagaatgatcatatatgatatggggttagacttattttcacagagcatggtgaatttgtacacatgcttcctggaccagacatacaggtgagggtaacatatcaatggtttaaggcaggagtcagctaagtttcatgggtgaaatctgaactagcacctgtttttaaaaataatgtttattagaaaatatttatgtccattcatctatgtgttgcctatggcaggtttcacacagtctaacaacaaagttgagtaggtccaacagggactggaaggcctgcaaagctgaaaatgtttattagttggccacttacagaaaaatgttgctggccccttatttaggaaatcccaccagacacgcatatcttggtctctccacctctttttctccatccctttgcctttttctccttccttccactctccatattgatggctacagttctgtgctttgggaagaagttctacctggaaataccagacacccctccaaaatagtcccattctccttacaaagagccaaaatcttaggaaagacaaagtacttccaaactatatgtcaaatctctttcataatggatcctattgctgaaaatgggatttgagctgatttagtttggagctcagaatgttttgaagggaaagaaaatattagaagacagaacaaatatttcttgggcatctttgggtaagacccagcaccttccactgggtgcttactctgtgaggcaggtgtcaacagctccattttatgcaaagggaagcacccacaggttaaaatccacccagggccacatggaagggatgacaaggtgaggtcaggactcacagccaggtctggctgaatctaatgccagtcctatttctctcatgggatatgctaagagagagatctatgtacaaacacttgttagagatttcctctctccttctcctccatgccccactcccaccactagccctcagtgtaaccttttctgccatgcagccttctggcctggttacatcgttcccagatggcacacaggacagtcacactcaaagaacccaggcagagtgtgcttttcaccaccaaggccctcttgccactgctgggcatggccttcctggtggccttgcagtagaaaaatagggagaggtaaggccccagctctgcttaccaggagcaggaaaaagaagggaagaggagagcaggccctttcccagcaggcaggcataaagcgagacaaaacaagaggtggcagacagaaaatcagcctccatcctgaacacctataagccaaacactgtgcaggtgtttctttcaaacattcactcatcattcattcattcattcaaaatattcacccagtgcctactatgagcccatccccctgtgcttgatgttgaggacaaaactggacacaaatgacaatgtgtctatgctcgtgaagtttccagttcagtggaggacacaaatagtactcagggagcatatcagtaagtgtaaaattatagtggtgaccaagtctacaaaggggggtacagcacagcatctggtatagaatgagacagggaaattaactcaggtatggacagctttgcagaaaatatgccatttaagtggaggtctcacgtgatgggggggcaggtgaatgagtcaaacggcagggaagagcattccaggagacaaatgttgtgaaggctgtggcaggacagatgcaggagtgctggggaagaggccccgggggagaggtggagtggggagggaaggagcggacagagccctggggagagagtcagggcaagatcactcaggattgcaggtgtgtagggagtttccatttcatcctgaaaacaaaaggaaagcattgaaagcttctaagaggagaaacaacatgatccctacttacatttgtaaagatgatcactctggctacatgattgagaatggactggaagacagcaagggagacttagcaagagaggacttttagcagttttaaagcaaaggatgcaggtggcagggactaggatggcagcagtagagaaggggagaacttgttggcagaagttgaagttataaaggagatactcattattttaatcttcacaatgaccctgtgaaggagatgtagtgactgcattttaaagatgggaatttgagaatactggttcatgtcccatggatgaaaaggggcagagccatgtctgagactcaggcaacttcccagcctcaactctttcaggaagccctcccacatttagctgctgtttattgtgtctttcttctcccaaagctgggataatctgaaacgctcagttcaataactttgtcttccaaaatcttctaacatctgaaacagtctgaactgcagtgcagggcccttaaccagtgctgatctagttgcttctgagcactcctcttaaatctctacttagagattgaaaaagtgagactcagagaccagcagggacttggccaaggtcacacagaaacgtggtggcaaagccaggactgaaaatcactgttcctgtcacacacagatagccccaaagactcaacttccttctgagtacttcaaagatggtaaagttgaatgtctttatcaaagcccacatgcctcgagatttggaaaacacagctcagctcctatttttcagatagacctgaaatggttacagtgaattcatatggagtcccaaatgctattagatgaccattctcaactagcacagggaactgcctttcctggtacttttatctctttcttcccctacctccttgaacttcatcatctcttctgtgtcaccgctgggctggctcacacacccctgggcagactgcagggaactgctgagtcattgcctttgctaaagaggagctgaaatggtgatggcagaggaataggagaggactgggatgttacaggtccaggcaggcctgggggtgtagggaagaaagaacccatcagcccagccaaaggggacaacagaaccattctagtgtcacagttagaccctaaaggagagaaacaggaaaggggagtggcactggacatgggggaggtaaacagggtgcaaaggaacctgaagctggaagccaggtatatcccaataacaggagattctcagaaatatgccccatgtcccattcacacacaagtaagaagagatctcagagaagatccacccgtccactctcccatgtttcagattgaaaaacagagatctggataacaaaagagactttactaaggtcacacagtgagttggtagcagatctgagactcccttcctgtccccatagtaaatccaatggtccttctcagcaacttcactctgccacaatttctctccctccctatctccacctaaatgccttgcaggtttcaagtaattttaatctttagaacaactctctatgctttcatcttaatatcctcattttacaacttagggaattgatgcacagagacgttaagttccatgattaatatgacattgccagtaagtgggggggctgggatttgaacccacgtaacccaccaccagaatccatgcttttagtactatgctctgttgctcttatatcaccaagggctcctggacctcccttggctcacctctgtcctgtgcctttttcccattaagtcagtgaatgctgaaggcaccctaactcctgcccaaactatatgaaacagaaaaaaacagatcacagccctttcatgaagaattgcgggacttgcagactgagacattgggttctaagttcatttgcctagaacaaagatgttgcagaaccaaattcactctctgtattcaacaacaaaaaattatagcagctgcggcagcaacaacaacaacctaacaacatcaaacacagtattaagaaagctctccctgtgatcctgcaaaaagcgtagggtaattcatgctcactgaatctaagcattcaattccttccatattctctcagttcccttccttgttgtctccttttcttttagcatttatcaccatctaatagatttgtattttgatataatacaaaccccacaagagcaggaattttaaattgttgtttggtttgtgtccccactgcctagaagagtggcaggcatgtagttggtgcagaacaaatatttgtggtatgtatcaaaggaagaaagaaaggagggagagagggagggagggagggactaagggagggagggagggagaaagggaggaagggaggaagggagggagggaggagaggagaggagaggagaggagaggagaggaaaggaaagagggaagaagggagggagagagggagacagggaggaaagaatgaagggatggaaggagagagaaagaaaggagttgctgggttaaatcattcatctcgaggcctgtagcttgcttttgcttttctaagttgaactccaatttataggggacatgctcagtgatgaatgtttttccaattatctataaatagcccaggcctgctgaggggacccattgacttccccagccctaattctgactgctggattgtgtgagggagaagaccagtcaagaatcatcaatcgtcaacttctaaatctccaatgcaggttcccggaagctgaggattgcttctcagttttctggctaagatcaagtggagaaagctgaggagcaggaaggagggagaggcagatcccatttttccaatggctacagaggctgcaaacccttcccatgtaatgtgtcaatggaaacactcctcccacgtggggcttttcagggaaagatgccagaggtgaggagataggaaaaacaacagtgagaactgaactgacattaataatgtctgacttattttgcttttagcatacaccagacaccataaattttttacatagcttaaccaaaattcatccacaaccccatgaggcagttacaaggtacagcttgtagatgaaaaactgaggcttacagaaggcaaataacttgcctaagagccaaaggagcacacagaagttatggggatctgtgcttttgcagtgtccactgtgcatggatagaatgcatgcagcatggtttgtgagaaaagttcctcctcctccttctccctaccccagctacttctcagcacacctctttgtggaggtaggagagaaggaccagtttccctgccacatgacctggacttgtcacaggaccttcttttcagtgggtgggtaaagcccatggatggatctgccctttatcactggcatggaatccatgtttgtaccccaggagagtctcttccaagaatccagtctcaaactggctgctttcccatccttatagacaatccaagatgaagaatcacattcacaggcaattgcctgaaatatgctgttttcctttcagagcacgttgaatcatcagggaacgatggatcttggccacaggttttagacctttgtggagtcctgcttcagcatttggccatccccctacattgagtgccattgtgagaaataattatccaatactgaattttatctgttgaagaaactgcctagaaaggcacacggtatcttatttatacataccaagttgaggactttacctctggtctggtaagtaaaatttcctgaacaaatgcttgattctttcccattaaccctgtacattttatttctgagtatgtttcccttcacactttggctgccgggaatttcttacttaaattgccagcctcttctaagaactacaaaacagtatggcagggattattctgcatcaacccaacctgggtttgaataattttccttattcttattttcatattaatatgattagttatttcatttcctcttttgaagttttaaaaatctgcataaaccaaaaacaattcacagtattttttgaagaataaggtgggacagaaagcaaataaagaataagccaggaaaagcattatactgaaggtcacccatatagccagggcaacagatactaagctcagttttaaccagatggggaccaggttagagaagatttaggatttgctagtgaacacaaaatctgatttccaggatttccttctacaaactctggttctggaaccttccaaggacactattacctttgctgcggcggcgactgcggtactgctccgtgtagaatgtcagctgagtttcatcgtctgcctctgagcccgacgtccccttggctctcccaaagctgattcctcctgtgagtaagcacagtctatcagttagtctcccaggcctccagaagtttgtgagattcctcaaccatcccagagatcagcaatcccatccccagacttttctctgtaaatcccaagcaacccaggagtcagtgtgataaatggaaggagttcatgctctgcagtgaagcagatcttgggtccaagcatgactcagcagcttctgagctgtgtgaccttgaagagaaaacacacctttctgagccctgggttctgtctctctaaaatagggataaaattattcaccttgtgagattgccttgaagattaaaggagatgtaatatataaaatacctggtccgcagtacatcctaaacaactgatagctattgttgcttttggtgataagcaaacactctagaaaacactctagacaacttaattttaaccacatttcaataaagtgcaagacgctggagatacaaagataaataggactcagtctttgccaggcacgggatcataagctagtcagcaggacaaatggaatcctaaggaagcttaaacctaattcatggcttctgtttaccactcaatgaggtgctaggaatatgggggagtgcaattcatttcaacacggagggcctgagaaggttttatgcaggagcgaagatttaagtcaggtcttgaaggatggatgggcctgcactgatagaaaaaggacttccagcagaggtaccagcttgagcaccctcaggaatgggccatgtgggcagtcaggggcaacattaagtggagaaatgactgggaagacacacagcgggaggccttgggtgccaaacggaggatagggagctttacttttggtttcatggaaggttctggagcaagagtatgaattggccagccatggtatatacaaggaagaacactccagtggtacctaggctgcaggatgggtgccaggcagggtaagcagccaggaggctcagtgaccacctaggtgaatggaggtcagggcttgcatgagggcctgtgcagcgaggatgggaggaggagatgagtgcaaagggtgcttcagagacaaactcagaggagtgtggagggaaaagggtaatgcattcatatgctgtgaacagctgattgtagaaaggataaaaaagaaggctaaaagcaattatgccacaatactaatagccattaattccaaagagagaaatatgggtatgttttattgttatctttgtgctttctgcttttttaattgcctaaaggattagtaaattatttactctagagaagaaataaccaggagagagagcctctgaggatgttgggggtgagtagatgggcacgggagaataaggactttggtatttaaaattgtttcattgatggggcttcagacatctacagcaatagactttctgggaggagacttaagaatctggtaaaaatggttgtcctggatggagaattaagtgcctgaaagatgggaacagagggaggctacttttctctataaactctttgcatcttttcaatcaagcaccatgcaaacctattacctattcaaaaatttcaactaaggaaaagaaaaacatacattaaagggaaatgttattcaatgcacgaaaggatttattatgtaatttcctcaggtagggtatttgaaatggcattcagtatacagaaattctacttgcagacactttttctgcaatatggttattacacattcattctttctagcaacattgttgcacaatctgctatgtacctagaagatttgtagacattattgctgacaatcctcatcatgatatactcataagagtggtgtaattaacaaactagataataaagcaaagatgcaaagacatgcttagacatgcaaagttacttgcatagtcacacagcagatgactaggagagttaagcttcgaggctagtctgtccaactccaaatttggtctctctgtaatatacacattgctttccttaaaaccactcatgagcgaaccctgaaagagcagatcatccttcgagtgtcaagatgctaagtacagcattcagagctttgtatacaacatctcattccgaattcatactacccttaggagagaggcatcattgtgcctactttacagatgaggcaagtgatgctcagaaaagaaaaatgatttgctaataatgagtgaaggtggacttcgaaaccaggtggaactaatgcccaagctcaaatttctagccacttatgatgctgcctctcagtttaaggctctgtaaaattgaaagattaatatctgcctccccacacccatccttccttaagacggtatgttctaatgagtgggaaagtacaaaggatgacaacatttgatctttgtcccaaaatgtgtcatcaggcaaggtctgtcccggagccttagtgcacacttccccaatccccagcaactaaaagcagggcctggagacatcaggagacttcagatttcagattctgccagatgcagttctccatttaaaggcttagctttgaagtggaattggcagggacctcatggagattttggaagtgactggagagcagaggtccccagaagccagtagggcttttaaaattgccattaaaatattttactgttaaaaaaaaaaaaaagaagaagaaagaacaaagaaaagaagggagaagggctgggcatgatggctcacacctgtaatcccagcactttgggaggccaaggcgggcagattgcctgagttcaggagttcgagaccagcctgggcaacacggtgaaaccccgtctctactaaaatacaaaaaattagccgggtgtggcagcatgtacgtgtaatcccagctacttggaggctgaggcaggagaattgcttgaacccaggaggtggaggttgcagtgagccgagatcaagccactacactccagcctgggtgacagagcgagactccgtctccaaaaaaaaaaaaaaaaggagggaggaagacttttgttcatctatacataattcttggccaaagaaaaaatgaaggcatctgataaagtcattctcttatgttcagaaaacatctgccatactctctgctatgtctggagccacagagcaaaaaggagggtctatccctgttaggaggccacccaagactcttcccacagccccttggatgccatagccacactttgaaacatttcagcaaaattctcactcccttccttccttccaatctccactttatcttccctcccatcctaaacacatgacctgttatggccctaccatggtgaacaaatctggcttacaggaatcagactttattctttccctactggagcaagatagacagagtgacagaaaagtcaccaggaaattctaatgtaagaaaagcgaacacttgcatagtgcagtatctcttccaggcactattctaaagcctttacatgggttgactcatttcatatttacaagaaccctaggagataggttactacatttattcccatttcagttggtgagaaaatgaaggcacgtagaaattaaatattttgtccagggtcacagcttgtaagtagcagaaccacgattcaaattcagacagtggcgggtaaatctattccttttttacaatgctggtttataataaaatatgaacaaatactttgtttaatatccacagccatccctataaggactgtatcatgagttttggtttcatagatgaataactgtctcagagaggtgatacgaggtagtaagtgggagaaatgggattgaaatttggtctgtctacctgcaaagcttgcttcgtacctaatacaaccagggaaagtgtgtgtgtctgtgcctatgtgtgcacacacacatgcatgcatatggatgtagagggctggcaaatgcttgatatgttgaccactaaggattagcagttctcttaattgactccaacacctggacctgttttcttgtaggaactctaatcaggcttagcaagatctttgtgactctcccatctttccacatgtccaggcacagtgaccacacccctataactaccataagggtttccataaaggctttcccttctggtcaagcctccatttccaaactcttctgacctttattcccttcttgtaagtactaaagtaccatgtgttcagagtgaaaactgaggctcagaaacaatgtctataaaccagattcaatagaaatataatgcaaaccacatatgccattttaaatgtttcagtagccccattaaaagggtaaacataaaagttcaaatgaatttccagaatatgttgcatttcactcagtatattaaaatattatcatgttaacatgaaattaacataaagttattaccgaagtattttatatatttttcataagtcttcaaaacccagtatgcattttgtgcttacagcacatcacaatacagacaagccacatttcaggtgctcaccatattggagaacacagttctagacatatttgtacaacaaatattactgagcaaattaagggcaaggatctgagtacaagatgaagatgaataagccacgacctccactaaaatgttcaatcttaaaaaacaatttggatttttgacctggatgaaaaaatggcacagctgggattctgttaaacaacagtatctatggtccctactctcaaggcacttggagtctagttagtttctatatttgtttatccatgagccaagggaagtaatggacttcagtagaaataaattaagttattggagtcagacatgagttctagttctttgattcacttattagcatatggccttggacagggcatttgatctctctgatctcatctttaaaaggggtacaagaactcagctcaatggttattattgggaaaagagtatgctgcatgtaaacattctgcacaaagaccaagaagtgagagtcagggcacattcctcaattacttgatgcttgtctgtgtttaacagaatgaaagggaggaagtgctgctggtttgaggtgccccctgactctcctgcctgctgtgacatcctggggaggtggcagccacccaaggcatacagcctctgagtatccatataatctgaaggggccacaggccaattacagtctgacttggaggtgattcagatggctagaaaagggccccctctgttagcattttaatataaaattggtgatttagtgcaataaaatgcagccattagttacacagggctgctcccgtacttccatttaggggctgagagaaagtgagaatggttagagactggcaagaaaaaagaagaggtaatctatctgctggaaccagcagcctttctatccttgctgcttgggcccttggttcttctggtaccacagagcctgaggtggagccattaagaaggtgagctaaacacatgccacggtgtgataagtactgccccaggtaccttacatgcaatatccctcctacacctcacaaggggtctgagatgtaggagttaatcccattttattggtggacaaataaatattcagaatctcactgttgcttaatcaaaattacacaaatggcagagcccaaatttgaatctgatgtatgtctgattcaaaaatgctctgttctcataaaaacatgcttactgtcattagtcaatagaaaatgcaaaccgaaaccatagatatcacatcatacccactaggtgggtgataatcaaaataatggaaaatagcagatgttggtgaggttgtggagacgttggaaccctcatacattgctgctggatatgcaaaatggtgcagccattgtgaaaaccactttggtggttccttaagaagttaaacacagaattaccacatgatgcaggatttccactcctaggtatatacctccagccccaaaactgaagatagggcattcaaacaagtatctgtacatgaatgttcatagcagcactatttacaagtcaaagggtacaaacgacccaaatgtcaatcacctgatgaatggatgaacaaaatgtggtatatagacatagaatattattcagccataaaaaggaatactgatacatgctacaatgtggatgaatgttgcaaatattttgctaagtgaaagaagccagacattaaaggcaacatagtatattcatattctatttatatgaaatatccaggatagctaaatccgtagagatggaagtagactagtggtggctagggctggacagaggaaaatgggaatgaggggtaacagttaataactattgagtttcttttaggggtggtagaaatgtcttggaactggacagaggtgatggctgtacaaccttgtgaatgtactaaatgccactgaattatacactttaaaatgatttattattattattattgagacagagtttcactcttgttacccaggctggggtacagtggcatgatctcagctcacttcaacctctgcctcctgggttcaagcgattctcctgccttagcttcctgagtagctgggattacaggtgtgcatcaccatgcccagctaattttgtatttttaatagagacggggattcaccgtgttggccaggctggtcttgaactcctgaccttagatgatctgcctgccttggcctcccaaagtgctgggattacaggcgtgagtaaccgtgcctggccaattaatgattaattttatcttatgtgaattatatctcacaaaacgaaaaaaagaaaccaactttttttttttgtaatatcactaaattagtgatagaaccataaatggggaatgtgagagctgtgagagagacagggagagggaaagttggggcacagagtggaagaattacatagccaccttgaaagaatcaagagctcagacctctggagtcctagcccagtgtgtggggatgcagaaggtgaccattcagtttgtcctagaccacatgttcacctaaaatcatcacaatactcactcatttgtttatgcattctttaaacaatcatttactcagggcccatgctgtcccaaacactgtctaggtactgaagataaagcctcaataaaacagacaaaaattactgatttattggagtttgctttctagtaggaaagcattttagatattcttggcataccattctagggcttagcaaagccttctacatgagaattcttacctcaattttgctgctaaataaatgaagatattcagagatatttaaagccttcccctagatggcatagatatttggtggtaaactaggaatttgaccccaggtgtgctctggggctaatcagggcatctgaacaacatgaaagtcatgttatggaaaagtatggagcaagatgatacaaggtctttcctgggcctatgagagttaactcactgctcttcttttgcaatctaccttctattcttgggctgccctgtccacagacctgctctgccagcctcgacaggcccagccctccacactccatctcctgctcttgctatcatgatggatggtggtgacatgttaaattattcaggctccgtgtcttcctcaagctggtgacagtgatattgcatttttagattacccagaactgtgccagataaagaaatatgtggttcaggaatggaaaaacccatctgacccccaaccatctagggaatacaaatggtcccagtcatagaaaaaggacagaagtgggtaaacttcccacaccccctataccacacaactcacaattgctctgagctctagagctaaaccacaaatgttcatacacattcacttctcggagatgttttgaccacaactgctacctgccatcaggcacctgctataggccaggcactttacacagaggttactatgctattcctccaaatgtggccaggagaggtggagctccttacttgtggtcacccatccagctaagtggaaggatatggattcaaaccctggtttgtctgatcccccagggaagaaatttctgcggcattcttgggattcatgctgaatttttaaaatggatttttatggtgaaaacctatatatgataaaatatagctaaacctgattgtttataatttcagggaaagaataagaaataactgagaggtccatttacagaagactgatgaaaaaatcatagcatatagtctttcataagaccattgaaaacagtgacatagatctaaattatagacatacaaacctctccatgacatacttttgggtaaaaaaatatgcagagaagaatacaaagagggactccacttgtgtaaatttatatatgcttgctcatatttggtatgaatgccattctgtgtatgtaataaaaataaagaagaaaaaagtaaaaagtcattctgagatggcatgatctacggttatgaacaaagttttaagaagcatataataaaacatattttaaaaacaacagtattctgtttttaaagtgcacacataaaatatatgtaaatacacacatgcaaaaacatattgaaggaaacatattaaggtgttacggtggtttttctctggatgataagatttaggtgtgctttaaaacatttcttattgttgctcctacgcatttaaaaattctcctccaatgaacttctaatgcttgctaataaacaaagatacctaataaaagctttgcttatttttttaataagtactctttattgctgcagtttaaacccattactcacttgacctttaacgtaatatggccatctcagagggggatcattccatcacccaagaaaggaaatgacccaatttatccctgaattttggcttaaataactacttacgagggagaagctcaccaatctagcttaactcactcttccagggaagtaacgctttgtcttcttgaacatcccactcctccctgtgggatggtatattttccaaatggggccataacaaaatctcccatcctgccttatcttttgcaatgagaccttcgccacacccccatcaaaggcagagtctcatttccctgcccccaaatctaggctggccttaggaacgtaactctaatctacagaatgcagaggaagtgactctgcaggatttctagagatagaacctgaaaagcaataaagcttttgtctggctttctaaaaacactggttctctagatgtttcctcttaggaaaactgccacggtgctgtgagattcttagccacatagaaaggctatgtgtaagtggttgagtcaagagtctcagctaagcccagcatttaagacatcccaccccatcccaggtggcaaaaacatgagagaaccttctagttgattctaccctctgccatctgttacccgtggatgttttgagttttccaagctgaagtccagtccttgtggaactgagataattcacctttcctttatcattatgactccctgactcctggaatccgtgagtataagattgttggtttaatgcactagctttgggatgttatatcatgcaaccataggtaaacagaacactccccttttccagtcctacaaaaatctccacactctttccaagttatcaccatatggcagcctgggcaatgggaagatgagctggtgtggtgtccagagaccctggtcctaggtctgtcctgttcctgacatacggtgtgactgaaaaatatattatcatctcacagatattgcataacagataatacttttactctcttcccaaacacagcagctcatttgacattcacaataactggatgatgggcattgctattcccacttgaaagatgaggacacagagggtcagagacactacagatgccttggtcaaggtcccatagctcataaatggcagagcagagaggagaatatagaaccaattctggaagctacagtagagtaagggggcagatttgagtatctgaggttggtcaggtattaagttccgtgaaatttccactttctagattccgtccagacttttgaaatggtagagtcagactgttagcttccctttatgatggtcctcagtcatctgaggttgcttatgtgcccactcacaatcttttcatccaagctacatatttcttttcttcttttttttttcttttgagacagaatctcattctgtaacccaggctggagtgcagtagcgcaatctcggctcactgcaacctccgcctcccattttcaagctattcttgtgcgtcagccccttgagtagctgtgatttttgtatttttaatagagacgggattttgccgtgttggccagggtagtctcaaactcctggcctcaagtgatatccacccccctcagcctcccaaagtgctgggattataaacgtgagccactgcacccagcccaagctacatatttttattaattccttcagccattccttatatgtttaaaaattataatttttgaattataaagtcagtacatatttattgtagaaatgttttcaaaaataagaaaggcacaaagaagaaaataataatcaagtcaaattttattactcccaactgacttctcttactttgagattttaacagtgcatttatatgcatacgtttttacaactaggtttcattgtcttgttacttgagcatatcctgtgaattttgtaaaaaatatctatctatctatctatctgtctatctatctatctatctatataccgatacatttatttatgctaggaatacatattggggttaaattatatacctgacagctttttctattatgtaatttacatatgtcatatgtgtgtctgtgcatgtgcacacatctagatttatatgtacaaaatattcatctatacatgtatctatacctacatatacccaaatgatactggtgattttctctgaatattgagatattcttcttatcttttttcctttttgtgagaaaataaatatagattgcttatggaattaaagctaattaaaatgtcataaatattatcattccattaagtattcatcttcaatatcacctaatgcctgaaaagttctactattgacatagtagaattactatgtcaatgtactgcttatttaaccaatttcttattgtttaaattttacattgtttccagtttttcactattttatcacacattcttacaggtaaatatttctacacatccctatgcatccccatgtagaaatttcttgagtgttgaaagagaaattgatgggtcaaagggtttcgacatagttaaggttttttgatctatattgtcaagacaccctcccgaaaggatataccaattttatcccaatcagctgtatatgagtgactatttcactgtatcttctgtaacactgggtattacatcattgttttcaaatcttagtaattttgatatgcatcccatatttcaaattcattctgccgtatcctttttaaaatagttcaattttctcacattctttttgcgttttgatgtccagaattgggcatgctaattcaggtgtgatctgacccgcatagagcaataatggactacacctccctctctctgaacacaagacttataataatgcagcccaagcctgcttcagctttattggcagctgacttacactcaacatgccctcagttccttgttgacatgcactgcaaataaatctggtctttcctatcatgtatttgtagaattgatgcttctaaaccaaagtaaagaacgttttgtactaccaaattgtatctgtatatttcaaccctttcttctagtctctcaagatgtacttttttggtcctaatcttctgatctcatagttgcagtattccctgactacaggccctttatgagttgaataaacctgaaaaggagcaggaggtaagaaagggaacaatagtgactgactgcctgctacatgtcaagcaacaggactaaacatttatgtatggtacaatcattgagtacatgtaagactgcaattaagttgatgctgatatccatgtgttaaatatcaataaattgatatcttcagggattgtcttgagaaagattgcacagccagtacagagacggggttggttgggaagtttaactgtggcccttgttattcccagtattccatgctaggtattcccttctttaagacactgacattcatgttggaataaaacttgacagctaatgggcagagaaccctcttcagggtgacatcagactgtgaatgaaaactctttgagaacatgtaattgaataaaagtaaaccatcttgactatactatcaagcagcctacaattgtgccctttggaaaaaaacaaaacaaaacaaaacacacacacacacacacacacacacacacacattttgttcattcaatctgttgggagcccataatgtgcctagaagtggacatgcactgggaagtgaaacagaaatagtttctgccatcagagagcttacatttaattgggaagattgaatattcaaataaacacatgcagaaattaatatacttgtgagaaccagagagttctcactagggaaaacctagcatggaatcctgggaatagaaagacacttaacttcccagcaaactccatctccaaactggctgtgtgaccttgctttgtcaaatatcttgggtgcattcagatatctggtatctgtggtatatccctgatcttcccatgcaacaaaccaacccaaatagaaatgcaatacatctggcataatttttcttcatgaacccatgatggcttctggtgctcccaacttcccttcacatattgaccatgtaaatttgacaaacccacctcattgtacttgagaatcataatcaagattcaatagtgcttcaccatttattagtaagctggataaaatctgtccttccggctgggcatggtgactcacggctgtaatcctagcagtttgggaggccgaggtgggcggatcacttgaggccaggagtttgcagcctggctaacatagtgaaacccccgtctctactaaaaatacaaaaattagctgggcgtggagatacatgcctgtaattccagctactcaagaggctgaggcaggaaaatcgcttgaacctgggaggcagaggttgcagtgagccgagatcttgccactgcactccagcctgggcgacagagggagactctgtctcaaaaaattaattaataaataaataaacaaacacagagggagaccctgtctcaaaaaataaataaataaataaataaaaataaataaataaaaataaatctgtccttcaatagaattttggaaactcttgttcctgccttgatttctccaagattacacccaactctctggttctgaaaacatctcaagattattttagcccctggaagtaatttgattgggtctagagatggaaatcaaggcagccacttcaaagtaaatacttaatacttctgtgttagaattccccttcttataaaatatctttattctccctttcttagttttcaggtttttttcttgatgtgtgacaaatctgacagaatcagaatgaacttagttctttactttcatctggtaataaagtttcagttgtttcatccaataggacaactattttcttattcttattgttccaaaagcaattttaaaagtttgttttacctttgcttattttctttcaaatttgtccaccatgcattgacaattttgaagcctcagcctttccgggagtattctcatgagtttgggctaaattgtttcacctttttggccttttctgtcatcttttagtttcctatacaagtatatcttctccctctatgcttcccaatttccctgctctttttaattgtctgtgattatttgttcagaattttatttttcagaatcttctctgaaatacgcctatttcacgttggaatctgctgccatagaaccaggaagatctatcctctgccattaaaatgttatgtatatatatgttcataaatttttggttataatttttcatcttttgaaataaaaaagttatttcttgctttaataatatccagtgctgtctggatattattttatgaaatgatcattttcctaaattgctgcaagcagtgcaaatttatacggtccttttgggaagcaatttggcaatataaaaaagaaccttaaaaaatgcccatccattttgacctgcttctgggaattcaccataagggacccatcctagacacaggatgggctttatgcactgttatactcattgcaacattatttataaatattggaaaatggaaaatcgccttaatatccaacttgaggggaatggttaatgatgttagaatattaggctttgatgatgatgataaaataatgtagaaaatacttacatttcaatacaagttttaagaaaggggataaaaacacaaatcctatgttaacaaaatgattaatatcaaatacagaggaggttctgcatatggtacagaggagtacgctagtaacagacctatccttgtgcagataataatgatacattctggacaaaatgccaaaaatactacctgagggctcctggaagtaaataaaagcagacatattttggaaagaagttgaaaagtagaggaagtagccagcacaggatgaatttctcatcttcaaggttcttcctttgagggtagtctacacttacagcatagctcagggaacctgaagcagcaggagtaagtttgccattgtctggactgaggacccagtggatggatcccagatcaagtaaagccagcagagagtgagggaagaatcaagaaaaggagagactcagagaaggggagcccacaatctgtgtataatctctgcccatatctccggctgacctctggactacacatgtgaaaggcaggccctgacaggctcagctgaagataataaaacacggagatttgagctgctgctcaccaaaggcaggacagctgaagtccaaccaaattaactgccttcaaaaacaaaacatgagcattaaagaaaaataacaaaacccaagagtcttcataaaataaattcacaattcccaaagttaaatccaaaattactcaacatatggtaaaccaggcaagtttcattcattcccaagggaaaagacaaccagcaaaggccaactctaagatgacccagatgttgaaattagcagacaagaactttaacagcaatagctgtgatcagttgggtaaaggaaatggtgattttaatgactaaaaatgtgaggactattggcaggaaaaaaactatatctacaaatatatgcaccaaatagatattttagaactgaatatgtataaaataaaaaaaaaaacactggatgggcttaattaaatgaagaaaataatcaatggctttgattaacagaacttttccaactccccaatctgagaaacgaagtaagaaaaattaaaccatgtctaaaggacccatgggacaatatcaaacagtctaaatacagataactggagtctcagagagatatagaataataaaaataaagaaataaaggctagaatttaccaaatttgatgtaagatataaattatcaaattcgcaaagctcatggaaaatcaaacatgatttaaacatgggaaaaagaaagagttgcacatcatagtcaaactgctgaaaatgaaatatatatagacacccttgctttagccatttcaataaagcaagaaaaagaaaaagcttaaagtttgaaaggaaggaatgaaactgtattttttaaagatgacataattatttataaaagtaagcacaaagaatatacaaaacaactattagaataaattactttagcatgattgaaatataaatggtaaatatacaaaagttaattgtatttctacatactggcagcaaaagctaaaaaaaaaattcaaaaataattctatttacaatagtgtagaaaaaactctcaaatacttagtaatatgtttaagaaaaggtatgcaatatatcttcaatgaaaacaatgtaacactgtcaagataaagaaaatctaaataaacaaatataccatgtttgcagattgtaatactcaatattgttaagatgctttctccccataaatttaatattgagtaaatgaaatacaagttataatcccaacaaggtttttttttttgttttggtagaaattgacaaggtaattctaaaatttatatgaaagtgcaagtaatccacaatagctaagtaattttatagaagaacaaagttggtagacttaacactgcttgtttttaagatctattataaagctgtagtaaacaagacagtgttgtattggctaaaggataggaatataaatcagtgaaacagaatagagtgttcagaagtatatacaattgatttttgatgtagttgtcaaaggaacgtcttttcaataaatggtgctggaacaactggagagccatatgctaaaaggaatgaacaaaagcccatagttcataccatatacacatattaactcaaaatggattacagaagtaaatgtaaaagataaatctataagctttctaggagaaaacaggagaaacattgttttgaccttggggtaggcaaaggtcatagatagaaaacaaaatgcataaatcataaaagaaaaaaattgagaaactggagtttagaaaaatgaaagatcttcttcttcaaaagacaccactaagaaaaggaaagacaagctacataatcggggaaaataactgtaatacatataatacatatatctgacaaagtatgtttataaagactcttacaacaatacaaggagataagcaaatacaaaatggaaaagatttgaagaaatacctaaaaatatatgaatgctgataagtacatgaaaagatcctcaacctctttagtcatcagggagacataaattatatcacaatgagatacaactgcacaacaattagaatggctaaattttaaaaagatcagtcttaccagtcttgacaaggttttgaagcaagtgaaactctcatttactgcagatgaaaacatgcatcatgtatccactttggaaaaaaaccctatttctcaaaatgttaattctacaacaaccaaataacccagatatcccattcctagttacacaagagaaacaaaaccatatatgttcacataaagacttctgcatgaaagttcacagcagttttatccacagtagcaataagctgcaaccaacccaaatatccaccaactggttggcagataaaatacagcatatttaggccaggcgtggtggctcacacctgcaatcccagcacattgggaggccaagcagggtggatcacctgaggtcagaagttcaagaccagcctggtcaacatggttaaaccccgtctccactaaatatacaaaaattagccaggcatggtggcaggtgcctgtaatcctagctactagggaggctgatgcaggagaatcgcttgaacacaggaggtggaggttgcagtgagccgagatcgcaccattgcgctccagcctgggcaacaagagcaaaacttcgtctcaaaaaacaaaacaaaacaaaacaaaaaaaaaaggatctactgacaggtgtaaataaaggaagaaatttcaaagtctttatgctgaatggaagatgtcagacacaaaaactacatactgtgtgagtccatttaaatgaaattccagaaaagacaaatctaatctatagtaacaaaaagcagatctgtggttgtctgatattgtaggtagaaagaaggatgtactgtaaaaggtcgtcaggaatcttttgggggtgaaggaaatggtcactggtgtatacatctttcaaaactcattgaattgcatactctaaatggatgtgatttcttgtaaacaagttatactttaataaagatcatttttaagttgcatgtagaaaaatataagtaaagcttgaaaaaaatagggcaaaatttatatgttagtagtttttggaggatgaggtacagaacattttcatttttgtttatactttggggaattttagaaactctttttaatgaacattagtcttttttttttttaaaaaaaaagtctatgggatttatcagattaaggccagctttgtgtccctagtcaaatgtgtgactaagatgtgtgttttagtctaatataactcattatcgaatgacactcttattgttggtcagacttacgggcagagcagtaatcccagagggatgagtatcctcacttctcctctgcatttcaggcatgaaattagaacacagacaattcaataatttatcagaaattgtgtttttagcataacaattcttcctgcagctgtctggagaactgaggccctcattgatacactgcattagctctgaattgttttgtatattcaaaattcatgttatatatcaatcatggaatagcaaaaaattattgaattagagtcagaaaacctaagtttgaggcttttttgttgttttgttttgttttttaattctgtgttactgtggtagctttatacatagccctgaaattcttgacatacttcttactgagatacaggatcttcaatacttgaatctgggagggcttgttactgctttgactaaaagaaaatgacagaattgaggctatgtatcttgcatggccaggtcagaaaaggccatgcaatgtcacttagttctcctgggacagaaaccagtcactatccaagaaacctgactactcagagattagcattttggagagcccacatgtaggcacaccagtcaacatccccattggagctcttagccaacaactgcacccatttccagccatgtgagggggccatttttgatgtccagctcagttgagccttcagatgactacagccccacctggtgtttggctacaactatatgagacaccccgaagcaagaactgcccagccaagccctttacgaattcctgacccacaaaactgtgggccaaaggaaaaggttgttgcttttaaccacaaagctttggggtaattttgtatacagcaatcatcaccattaacagtgaccttaagtgagtcacttgagctctctaaactctaagtctcacatctctaaaatgggaatatatctattctaggccgggcaatgtgatggctcacacctgtaatcccagcactttgggaggccgaggcaggtggatcacttgaagtcaggagttcaagaccagcatggccaacatggtgaaaccctgtctctactaaaagtacaaaagttagccaagcatgggggtgcatgcctgtagtcccagttactaaggaggctgaggcaggagaatcacttgaacccaggatgcaaaggttgaggttgcagtaagccgagatcatgccactgtactccagcctgggcgacagagtgagactttgtctcagaaaaacaaaacaaaacaaaatatctattctatactatggtcacaagtcttaagtgagataatacatttaaaaggatattggaaaccttggacaacaaatagctgtagtttcatttattcaaatattgatttgtttactcaacacgttgtttgaatgcctactacatattaagcctgtgcagtaggctaggggtataactgtcaataagagacaattgctggccgggcgcggtggctcacacctgtaatcccagcactttgggaggccaaggcaggaggatcacgaagtcaggagatcgaaactatcctggctaacatggtgaaaacccgtctctactaaaaatacaaaaaattagctgggcgtagtggtgggcgcctgtagtcccagctactcggcaggctgaggcaggagaatggcgtgaacccagaaggcggagcttgcagtgagctgagattgtgccactgcactccagactgggggacagagtgagactccgcctcaaaaaaaaaatgcatatatatatatatattgctcccatccaagagctcacattcagatggaggaaatggtcaagaatccagaaggcagaatgaagtataataaggctacagcataggctaatgcaagagctgtggaacacatggcagggcctcactcctatctcctgggggtagcagaaagaatggtcaggatgtgagattagggttgtgtgtgtagtgaggcatgagaatggaggaaagatgatcacacacaagtgaaacagagattctggcttggctctagctttcagtcagtaagctgaaactagtaaaagaatgtgaacttctctacagagataagggttttcttgtgaacctatgtagattggtcagaacatacttttgaagcatgatggaggcactacagggtctttatcatgtgcatctttctggccacacaagaattaaacaaacacacaatcaggaacaacagattcaactgctaacttgaataatctttgccatttgcttgatcaaagctatagacaatgttaagggaaaagatttcatcaaaagttttttttttttttttaattctgcacaatgctagtctaggagaatggtgattctggaaggcaacagtggaagctttgctccaaagtccttgcaaaactgctctttccaagctaggctacatgggaatgtgcctgcctccatggcctaatagttgtcctgtggccagtagagttatttccaattgttcctaaaaagtctctctgtgtgagtgtgtgtgtgtgttgatggggttttgaggcagttctggcatgagccaaaaaaaaaaaaaaaaaaaaaaaaaaaaaaaggcctttcccattcatcgtttaattaggtctaacaattacataatgtaagcagaatgtcctattactgatgtataaagctttatgcttgggagatgacagtaacagattcacaatcaactcctgggtctctggacccagtgttctttctcatacctcttgtggacaatatggtaataggataatatggtaatatgaatgcttaagcatggggactggtggtgataacagtgaggttttcacagcagtcaagaaatcaggcaagtgaaaaacagagaggggctcatctttgggatggggtacctcagtttccccttagctaggaaaaattcattactctctgtggaagacacatgaaagtttctacacaaacaccaaacttaactagctcagatccaagtggaagggactaaatgtaagttgctatttgcactttttcttttctttcttggacaagtgtagggttttaaacagctctgggagatgggaaaaaagcaaagtggagaaaaaaaaaaagaaaagaacgaagaaagagaaaaaaaaaaaacgcaactccactaatacccaaagttgtgtcaacaggctgttttaggaaagaatgagggactttgttgagagtgggaagggctcccctcacctactgcctcaagatgtgagcagaggctttttctctccctgagctcctgatatggttcctggcacatagtaggagctaacaagtgttggctagaaggaataaatcaagaggagttctcatcagcaccccctaccccatggtactgcagatgttttgatgagatgttttccaatttaatcctgtttgctgagttattagcctgttaatctcaaacataaataatctaccatgtgctgagagtctgactttttctttccctgagctaacaatccccaacagctcttctacgtttctatcccaggagaaacagtatgctttctaagcagccgtcacactccatctttcttcagacatggcactcattcccagggtgaacttcgcaggctctgggggtaagagccacccaaaggcccctgcgtctcatggcagcagggcagaatgtaggggaaaccccttttgaaaatcaccgttatattaaaaaaataaataaataaatcctgacctcttcacaaacccaacgaggaaaaaagtgccaggttgttcaaagggattcactgaccagttataaggaaagctcagtagccgagacctaggattcttgggtctacatcctggttctatcagtgttgtcatgcgggtttaagtaatttaatttccctgttttcttttataaaacaaaagtaattctatatttcccatatggtttggaaagctactattcagatgagaggacatcacatggttaagccagagttcttttttgcccttcctaagacagctactggcccagttgcccccatcctagatctccagtcatgaacttacccagaccaaaacatggtagtcatcactgatccctttttttcctctcctagaggacagccaatccagatctaagtcccattgtctctaccaaaaaatcctaaggtttgatcatttctcatcacctccacagctgcaacattagatgaagctatcatcgtctgtctattttaccacaaaatgggctttctgacactctccaggcttctacatttatattcccaatgcctattccatgcacaaaagttagagaggtcagattataaatgtaaatcaaaccaagtcctttccctgttcactagtctccaatggatgctcatcagctgtaaaacaatactccaaaatccacagctggatcctaattatgtaaccccaggctatttttccatctttttctcttcctgcccttctcactcaccctggtcttcctgcaggccactgaatacattaaccttgttcttgtctcagggtcataatactgttctttctcttcctacaatgttgtttctccacaggtctctgtgcaactgtcacctcctcaagaagccttctctgaccaccctaagatactcccttcctccacctcctcactctatctttttaccctgttttatttttcttcataacatttattgctttctgagatgatgtcatatctacgtttattgcctctctcttacagaagaatagaacctgcaggagttcaggacctttgtctttttatcaccatactctgcattcacttaagtgcccagcattgggtaggcattcaataaatacttgttgaatgaatgaatagataatgcacagaaaaatttaaagctaaacagtagaaagaaaaattgtaaattgcccactctgcctgccctctcaaaacagaaaaggatttacatgcaggtttgaaaacatcttgcaaacacatatacttttggaaactcacctgtttgtttaaatgaggaactctctggggagatgaaagaaatgaattttatttgattaggcatggtgtgctatttcccaattgcttctgagtttgcagaaactggcttcaggttcaaggagtgggaatgcccaagcttcctgtagccaggacaaggaggcccctatcatgtgtgttgaggagaaggtaaactagggtgtggcctcctgatgtcctgaccctctccagcacctccttctccttactctctcctgcatctcacagctttcactccacagcttgcaatcaagcctacccttacaagtgctagaaagaacacatgcaatgattgggagctagatttgagtccaacttcttccttcatgtctgattttcaacaaattattaaacctctctgaatctttttaaatataatttttacattatttgaaatatgagaaagagacactaatcctcacctcaccagccttcctctgatagatgggatttgccagagactgacaaaaatgagggcatcccaatgtgacacaatgtgacacgcatgttatcctgaatttcataggaagatggggtttgactttagaagctttcctatgggtagattttgcaagatggaggtgaataaacaaaatagcactatagcactagaatgtgaaaaggtaattccctcacacagctattatttcatatgaaaggaaatcatatatagatatctctatatatttgtatgtgtgtgtgtgtgtgtgtgtgtgtgtgtatatatatatatatatatatatatatatataccctgagtatatatactcagagattatgtaattgtgaaatgctgaaaaattacaaaatattttggctcctattgggtgtgggggtgggaataaaacactggactggaagaaggtggtggctcattggaaaactttgtcatatctcttagtgaatgactggaaactcaccttcccacacgtgttctgagaacttcctgcacaatgagtcatcacgttatgatggcaagtacttgctcacacctacaacatgcccactttctggacctgaaccagttttcagacttgtattcaccaaccaaaggagagcctgggtgcccatgaggaaggccaccatgccacagtgagtgtatacagtaatgtctcctctaggccttcctcagagggacttatggacttttatttggacaatcatacaccagaggaagaggaacatccagacatttcaaagaccattgagtacaagttgacagtgatagcagagaccccaggcatacttagagtcggggaccaaggggttccaggtaacagaatggagtcacaacctaggtgtagctcacagtgggaggatcctctccctagcccccaaatgtagaattgacacagccatacttggtggctggaagaatcctcctctcattgtttctttggactctgtgttaaaactatcataatggggaaggcaagtggagacatttccattgccacccaagagaggaaactaaaactaaagtctcatcctgtaggtaatggaagcaatcagtgctatacttacagactttaaggatgcatgagtgatggtctgtatcatattcacatttaattcaccagtcttgtcccttcaaaattcagatggattcaggagggtaacagtgagctaatacaaactcaaacaaattgtaggcccaagttttgcagttgtcagatgtagtgtctatgctacaggtaattaatacagcctggggtacacagtatgtgtccattaatatggaaaataagttttttcttttccatctctatctggtaaaattattagaagaagttcacatccacatggggtaggcatcactacacatttgtggtcttgccccagggctttattaactgttctaccctctgtcgttacataatctgaagaacatggaccatctagatatttcacagagtatcacattggtctattatgttggtgcatcactgggctagaggaacaagaaaggaaaaatatgttcaagattttggtaagatatgtgctttagaaggtgtgagataaatcttatgaagaatcgggggttcactacatcagtgaaaattttagagttcagcagtctgtggcatgccataacatcccttgcaaaataaagaataaattactgcatctcacagctcacacctccaggaaggaagcagaatgcttggtaggcctcttttgattctggagacagcaaattacacacttgggaatatttccctgacccattttccaagtagcatggaaggctgccaactctgagttggatcacagaacaggaaaaggtgctgcagcagttaggctgtgatgcaaacaaccctgccatttgttaccatatgacccagtggaccttgtattagtccattctcactctgctataaagaaatatctgagacggactaattcataaagaaaagaggttaaatcatctcattgttctgctggctatacaggtttctgcatctggggaagccacaggaaacttacaatcatggcagaagccgatggggaagccagttcatcttcacatggccagcaggagagagacagggagtgagggtagacgtgctacacactttcaaacaaccagaactcctgataactcactcaccatcttgagaacagcaagggggaaatccgcccccaagatccaataccatcccatcaggcccctcctccaaaactggtcatataatttgacatgggatttgggtgggaatatagagtcaaaccatatcacctgtaggataagagttcctggtgataataaatactgtgtggattgcaagttccaatcaggagacacacaatgtagatctcctgctctcagagtaaggtcatgccttctgcagcagaaagaatgcatttgaaagaaggaactttcccgtgaaagtttcaggtatgctattggatgctatcaagaaaacatgcagccataatctagcagaagtcatgagctggttctgtcagaccctctgagtcatgtggtagagtatgactctcacataagatgagagtggcaaatcacaattaggtccaagcaagctcaagggatacaaataaactgcagtagcagatggcccaggtcccatagcatccaccacaattgcactagtgcctctcactcaggttgcatttagggacacctgggagtggggagggaaaaggataagcttattttgaggagaggtattggctctgtatatggatacaaggatacaagctaaaaataggaccactgctaagcaatgggcagcagtctgaagtgtccacatggtcattgactttgtggggaaagagaagagatttaaggtgtggatgcatgattcgatttactggctaggggcttgacagagaaagacaggacaatcctcccttttgcttgttcaacaccaacttaaaagactttatgaagtcaacagggtggctacggctgtgttcattgctggtggtgggtttatggaggaggaggcaaacagagacactgtggaacttcctccttcacttttagcagttcagacacatgccacaactcagtgctccatgcgaaacatgtcccaattccccggagcctgcttacaaagcttttaaccctcaatgtctttcaaactgactttgatcatccatataaaacagaatagcaccaacacacacagaccagatgaggagcagaaagctccaaaaggggctggaatcagtgacctccaggatacccctggccctgagattactgaagaggaagccaaggatgggaatatcttcctagtgcagtggctctctcacttaatcatgtatcaggatcacctgtaaggccgttaaaacacagatcatcaggctccaccctacagtggcaggggctgagaatttacagttctgtcaagttcccacgggatgctgatgctgcgtgttcaggagctaccctctgagaatcactgtcccagagcaatgaggatgcaaaaacagacctgtgggcaccactccaagctttagcaccctgtgctcaagcagaaggcttccatgagagaggccatatgtgtcacagttaagagactggactttggggttcaattaatctggttcaaatccaggttttgccactgaccatctatttgacattagacaagtgggtcttgcctcgtgagccaaaattttctcacctgtaaaatatggataataataatatatacactatgaaaatattgtgaagtacagttagataacatatgcaaaatcaaaagatgcatggtaagctcttgataaataagaatacaatgacaacacacgatgctagtgttactaccctgtagagtactggctgaatgtaagaggctgtatttctactggctctagcccttattctttaatttaaatattcatctttggagactcagagaggtaattacattaagaggcaagcaaagcaaagagactgtaattgggactgtaactccacccttctccattcctccctacccacctctcctcagccctcttctccaaggtcagtttgtttaaattcggacttggacttcaccaggaattggtttcacattcttcttactcactgtatcaaatgagtatgagcagccatattctttcctctcatctctgcgacatgcctgtctgtgcttttggaggctgatgtcaccacagcagttaactcacatgcctggcacgtagcgtacacccgaacaatatttgttgaattgcatcgaatttataggaattaaggagacaggattttggatacattttcatctctgtggtgcatgaccttggattagccacgcccccttctccaggtctcagtttctcacttgtgaaaacagggatttctcaggcttcttccagcttagctatagcatagtgggcagagatctgaactgggagtcagtaaaccagggttgggggcccagatatgccactaactcatggtaaaaaagttgctttccctctctgtgcctcagttttctcatttgtgttatgggacgatttctacatacccacctcccactccacattcctgaatttcatttaaggccttttgagggttcaaggtcacagcctttaaacagtatttgccataacaggaaaaaagatatgattccttctatcatcttgatgtggccacattttactggaggcttctggaatcttgctggataaaatctcccataacaactcacagcaataatgatcattaatattgtatataatcattaaaataagtagcatcatattactttcaacttaaatggtatcttttagctgagagtctgctgatgctttagcatgacaagtgaaggaaaggaggcactgctgttggagttgctcacttaaatcttccttacatgcattttaaacctaaaggaagagatgggagaagttatttgatatagcattagattttgttttagaagctattgcttcacagaggttgaggctgtagcgagccaccgttgcaccactgcattccagcatgggtgacatagcgagaccctgccaccatgaaaaaaaaaaaaaaaaaagctgcatgtggcatctgtgccaggttctgttactttccagctgtatgattgtggtcaaagtgacacaacctctctgtgtctcagtctactcacctgtgaaggcttctctgcacatttcacagggttcttacaaagatcacctaagatagtaggtgcaaaaatgtgttgtcaactgttaagctctctacaaacacaagacattgccattatggtaataaaaatcaaatggcacatgaatatttcagaagcaaggactaggacagatgtgtaaagtattcccttctaatggggttttataaatacatgctccctcttcttattactaacttcttaataatctctttgcaaagcttgtcttcaaacaccctttgtctcccccatcatttcttcttaacatctcctctctcacacagctatttacttttgaactctgggtggcatttggggagacagttggttagaaaaatatacacatacatattttgtacagagacataaacaaaatgtatccagggcacctcaattctgagccaagatattaaaaaatatatatcttctttgtgatctgttgcagctgctcatattagcaatacttagtctgaaattaggtttaacaactctatccctatatgtagccacaaatatgttcacatgtggcattaatgtggaaagaaaacaaatgaaatatgctcagatgcattttcattctgttaaatcttaaagaaagaaagggttttacaaagccttttggagtctctcttggctaaaaaggaaatccttttgccattaactgctcctgcagagagagcctgctagctgcaagatcatgatgagggtaagcattaattaaatctaactgcgagagaataattatgtacacatatccgtcagggcaggttgtcactatccagtaacaaagttggatacaaactccatcagcagaactgtcaggcggctgttaaaaggatataaatgtgtcccaaaaggatcatttcattgcggcgggggggggaattggattgcaaaggattaatgaggcgaggggtttgtgttttcaattggatgtaaaatgcaaactaagttgtggtatcatcatttaaccttaatgtttagctacatttggatttttaccatgtgatggggacaattagaccttgtacatcaaaccagcatttttccatcatggaattacattaaaggttagttgtttttttcttttaagttaaattgcacaaaagtttacaacaaaatcataaaacccagtttacacagatggcatattcttaataataattaggtcagaaaatgaatatgaatcccaccagagtaattaggatattcagtaaaggaccctttttgttgctgccttatttctgtcaagtttcagtctaagctctgaggcctatgtatgtgcagacatcccacacaggtaatgtgaatgcaagtcttggaggtatgtgctgctaacagacacagctacaatgtagcagaaggtacaggagaactggaagcagtcaggtctaaatttacctccaagctcctggctgtgcaagtttgggcaacttacttcatgtctctgaacatccatttcttttacaaagtaagggttagagaaaggttgttacagtaatacatgtgaaactcattactcttaaaagagtaaagagcacaaaagaaatggccaataattgtggtttcctatcagatatatgtcccaaattagaaagtagaataaacaaaaccatgacactagctttgagattcattcctcctatagtttcatctttgttggaggaattaaagagagtatttccagccaaggcaaaggagtaggaagcctaactggtttcactgcagacttggtggacaactagaatggttagcaccaaagtaatttactccagtgaacgtttaataatctgtaattattatacttgaatgcttgagtgagtgattgattgactgtctgcttctttctccaaatcttgagttacatagaagtgaggacctcatatgtctagatttccattgcagtctcagggctgagcatagtgtcttacactgagtagacattcagctgaaagaataatgaaagtgaggttggagaccctgggtaggtagttaagcttagacagaaggaataggcagggctagaattggggaaatgggaattagtcacagcagccctaaagagcagtttggaaaggtatcatcctacggcaggataattgctctgacttggacttgtatagctctgctgggaccacagatgctgatctaagaatgaggccaaagagtctatcagagatcttagccatcctgggttgctgtagttattggtataattacctactcttgaattctctagatcttgtggagttatttctatgtagttctgcctgaacgcaagatgatttctttgggacccttctccatgttacaatctgtgaaggttgctccgcaacactgcactgaaagggagctcaccagcgtttctcggctaacaccctcggcaggtagcaaggctgatacagatacaggaaggggtcaggtgttacagctgctccctgcaaatctttataactagatcacacataggtaatttggagaaggctctttctctctacggaaaataccctgacaaaagctttatttccatggttttgtaatggcccaatgggttcatcttgtccattgcctagaaaagctaatgcactgagaacagcagatttttacaatagagagtttaattattgcacagccagctaaatggaagactggggtttcattactcaaattacagtctccctgtgatttcagaagttagggttttttttttgttttggttttttttttttttttttttttttttgagacagagtctcactctgttgcccaggctggagtgcagtggcacgatcttggctcactgcaagctccacctcccgggttcacgccattctcctgcttcagcctccccagtatctgggactacacgtgcccgccaccacgcccacctaattttttgtatttttagtagagatggggtttcactgttttagccaggatggtctccatctcctgacctcgtgatccacccgcctcggcctcccaaagtgctgggattacaggcgtgagccaccgctcccggccgggttttttaaagatagtttggtgaacagggagttagggaataagaaacacggattggtttggtcagggaagaaatcatagggagtgaaagctgtcttcttgcactgagtcagttcctgggtgggggctacaagaccagataagccagtttactggtctgtgtggcaacagttagtccatcagaaatcagggtctgacattctggccaacatggtgaaaccctgtctctactaaaagtacaaaaaatagctgggcatgctggtgtgtgcctgtagtcccagctactcaggaggctgaggcaggagaattgcttgaacccgggaggtggaggttgcagtgggccagatcccatcactgcactccagcctggtgacagagtgagacactgtctcaaaaaaaaaaaaaaaaaaaaaaaaaaaaagaaatcaaggtcttaaaaatacttcaaacactaatcttaggttttatgacagcgatgttatctataagggcaattggggaggttaggaatcttgtggcctctgactgcatgacaccagagccataatttctaatcttgtggctaatgtgttaattttacaaaggaggtctgatccccaggcaaggagtgggtttgtatcagaaaggggttgatgccatctttgtttcaaagttaaactataaactaaactcctccatagttagcttggcctatgcctagggttgaacaagggcagcatattagtccattttcagactgctgataaagacatacctgagactgggcaatttacaaaagaaagaggtttaattgaacttacagttccagttggtgtagaagcctcacaatcatggcggaaggcaaggaggagcaagtcccatcttacatggatggcagcaggcaaagagagaatgaggaagatgcaaaagcggaaacccctgataaaactatcagatctcatgagacttattcgctcccatgagaacagtatgggggaaactgcccccatgattcatttatctcccaccaggtccttcctacaacatgtggaaatcacgggagtacaattcaagatgatatttgggtgggcacacagagccaaaacgtatcaggcagcttgaaggttataagcaacatggaattggttaggtcagatttctttcattgtcataatttttgtaaaggtaatttcaatttgaagcagaaatatgagatatatggattgaaggcaaataccacttctttgcattgacagtgaccatttttctagaaatgttctccttaaccacaacctctgccatacccacttcctccctccgttcctcaaaaaacaaacaaaaacataaaatctgcacatgaattgcttctccctatctccaccccttgatgtaaaataaacgactttcagacagataaaaattaaactacatctagccctaaatgttgcagagtcatcactgaaaataaaataaaatattaagaaatggccaaagccagaaaattgaggttataagacatcaagatccataaacagaatttctctcttcttaagaaaattttttaacctctaatttttgagggcagaattttatatatgtccattttattatatctttaatagtgtagttaaatttttctatattattattagtagtagtttctctacttggtctaataggaagatttttgtaaaatgtctcccacttggactatgtattaatcaacattccctgtacttctctcagttttttcatttaagcattttgaaaccatgttgttcctatatgtaagtacaaatttcatttctctcccagtaaatggtttcttttttggttaattaataatactctctattcctaaggatttttccttgttccttcttattgttgtaaaattaattttgccatatgattccatttttttataagccttcatttgattagtattcacaaaatatatatttttcctttccctttccctctgtcaaactttgtgtccttatgctttagaatgatctctgggaaatagtatataactgaattttgtttaatatatcctatcacagggccaggcatggtggcacacgcctgtaatcccagcaatttgggaggccaaggtgagcagatcccttgagctcaggaattcaagactagcctgggcagcatggtgaaaccccatctctaccaaaaatacaaaaaatttaactgggcatagtggcatgcacttgtggtcttgactactcaggaggctgcagtgggaggattgcttgagccctggaggttgtggctgcagtgagctgaaatcatgccactgcactccagcctgggtgacagtaagattgtatctcaacaacaaaaatgaaaataaaaataaaaactatcactgaatcttaatgtgcaaattatatttactgtaatttctgatgctttggggtttattcctatcactttatctttcactttttccttgctcaggctttctctctacttgtatcccaccccacctgaccccctacctggagtcatcatgacaccagcttctgaactcatagcttggctttgcatttcttacaacttatatctgcattccttaagcccggggggcttcctttctttacttttgggatgaatcttaattttttaaaaagtatattttgtccaacatttattttgtgtgtatggaacaggaagaaggctcatgttagctttgtcagccatattgctgaaagtttactacatgacttgcctgttttctttccatgtaggaatgggagcttttgctatacacacacacatacacacatacatacatgtgcaattgcagaattgagatttttctatcaaaatattgaagcccaatatataaacatagaataaaagcttgattaaaaagccctacctattcagccacagttccccttccccttctccctgagcacctatttgtggcatgcttgaaaacatctgctaacggcccaggcagtctatctcatatcctcactatgtttaatcatgtatatctcaatcatgggaaattgtaaagcttctctttgtagtcttctaagtgatttatgcagttgattacagctgaattagaaaagagctgaagttgtcaacttctaactatgtattttgttaaatttcaccaacagtcagtcctaatgtaggtaatagggcctatgtggaccaaaaataaaaccttaagcctgcccaacacactgaatgaatcccctaccacactcaaagccaagagaaacctgaaaagctgaatttcccattatgatgaaaagggcagtcagacatgtctcattatacccctcttcttttggagtttaggcacaactgaccagcattaatattaaaatagagatcaaaagactgacaaaatagatgctgtagcaataagacaccgaattccaacctgactctgatgtagtaacacatgacaagtgaaggaaatcaaaatattttaccccaaaatatattttcttgatgtattttgaaatggccttgcaaaaccatcttttgtggggaaaatttgcatctgtagagaatctccttccctttctaggtctttctgcaaatccaggagaaattaaatgagagtctggtacttttaaggtcttaaaaagtacatttaccatattctctctaaggttactgcctggaggcttcatctacataacaagaaccttggcatctacaacccccattatcttaactcaagcatttacttcaagtctttagataatgtttaactcaaccaattgccaatcagaaaatcttttaatccacctatgacctgtaagtacccctgaaccaatgtataccttacatatatcgatttatgtctttgcctgtaacttcagtctctgtaaaatgtgtgaaaccacactgttactctcaggaacactttctcaggaccccttgggactatcatggtctatagtcactcatattggcttaaaataaacctctttaaatattttatggattttggcttttttaaaacatgattttatatggtcaaatggcataaatagccaatgatttcacaaattagaggacttgaattattccattcctggatctgctagtttctctgtgtgacatcagtgagtccctgtctccatcatttccacatatacaagcagattggatcagacaatgaagcagaatgatgatgtgtaccttttgggctcaatccaaaaaaccttgcagctcctacttctgctgtttttggatctcccaggcatgtgaaccaggctgggatagctggctagccagaggtgcatgagatgtcagctgaacctaccccacccagaccagaactaaccacctggagccaagcccaaatgtttttattgaattaagtgctaaataaatgggtgctattttagttcactacgttttaggttgttttattatgcaacaatgctaacatagcattattaccattctactgaaagaaatatggtagagttgtatccctaggccccaccaggatctggtcgtgagccttccgctaaggctgctttcagttgcctctccatcctccaggccagatagaattgactgagagccccctgatgtatttcagatggacaagaaaaagctcctgaaggagacatacactttcaggaacacaaacttctctgaaagacacatcagggaagatttatggaggcagttgtgtgctctgactgctgatcagctttcttatgtctcagtacaatacaacctgtgggtcaccgggttggtggtggtactctccccggctgcacctcttagaagagacctgaggtcaacagacagaaagccagagactgagggaaaaggtttcctaatcaaagatacatgccatttcttatctttgaagatgccagggtgccgattccaggatgcaacaaatctacagcatgctttaaagaaggatttccataagcatcctagcatattctcacgacagtcctggacaaaagaatggcagatattctcacatccccagatactggggatgaataatatccccaggatattaaggatattaagcagtttctctaaagatcctccctgagtatccattgcacttagggcagggttggggttcaaaccagaagtttctgactccaaattctgaattgtttagtgtacaacaatatttttcaattgtatgtatcatcaaagactatttgagttgggggagacctgtggaaattatctagcccatcacctttgctttccaaattaacaacaacaaagattcattaggtgcttaccatgcttagtacagcctgcggagcactttacaaacattaactaattctcccagcctccctgtgaggtgactgattgtatgatttgtagattaggtaatggagatttgatgcataagtcatttcccaaagttgagccagtcagtggcagagctaggatgtgaatccacatctgtctgactccagaccctgagcacactgccacaatgccatatagccttttagatggggacactgaggcccagagagtggaaggtcttgtccaagatcatgaagccagtttgattaattgtccattaattcatcaattattgaggatctgctatttgtcaggaagcaggctagccaatgggaacacaggcatgacctagatatagttgtgcacttgagagtaattaagggagaagataagaagtgactataaattacttgaataaaagatagtaaatgacaaatatctcagggaagatagtgaagaggttgtcaaagtttggaggaggtatgcacgactttcatttgggaaaaatttgaaaattcttcacagagaaaatggtttaaaggtcttgtttgaaagaagagtagaatttgcatattggcaatgggaaagaggaagaagttcaagctgcaaaaagcgcatagaggtggaggtaaaaggagttatttcatcatagactcagggctggtctccaggtagttgtgtctatccagtcctccttgtaacccctataactatctcatggtttaagtggaacctcattttgatgatgcaatgtcaaaacttcctttgtcaaaaggggcggtaaacctaaatcccacccaaaaatccttggtaggaagggaaggctgctaagaaggacaaagtgtagggaagcaaagatggggaccaaagaaacaaaggaagatcaatcctgggactacctgttcaatatttaagcagagcaacgacccattaaggcaactaatttaaagtcgctaatgtttctattttcttccaactaattgaataattcatgaccagttactaatgaaaattatatatatatatatatatatatatatatacacacacacacacacacacacacacacacacacacacacacacgcctgtgttccagggacagtgtcccacagtaaaagcacattgaaacattgaagcttatctatcaagaaggataaaggagccagaatttgcttctcctcccaactgtgggatgctgctgggaaatgtgtgagcaagatccaaagatccagggtctgattttgatggaggattttgtggcttcccatcttcccactggcacctgcctggatcacattttcccccagatattcccgttaccccctgcacagcttcatccctatgtgtatttgcatattttctttattctaccagcaatgtcttcccaaactttctctttatttaatgcattacttaggattacctgctctgtgaagccttctttaattattcccccagtttagtaaataccccaagccagcccacaccaccttcatgtatccattgtggtgcagatacgtaatgccctgcttccttcaataaatggtgaagtactggtaggccgagatctagttggcatataccacacacatgtggcaaactaaaaacattgagagtggatgtcttaaaaaatgcacagagcactatccagtgacgtaacactgtgggctcctgaggacatgggactggctccctggggttagttaaaagctgaggggacagtgctgattcattcttagctcagagagggagatgcctcaccttctagagcctcatagctcctgaacaccctcacagcagcactgatgacacagaaacactgccaatgcaagagaagctgcacgtacttccttccaggatctagactaggtaggtataatttcacagctcaaagatcttagttgtggtagctaagagtagagctcaagtcatctgggaatttaaatgtgggctctgaattcatagctccactatgtactagttgagtaaacttagacaagtgactgaaactgtgtaagcttgagtttccttctttgttgaatggggataattatagtacttaccttatgggttattgggaagttttaaataagataaaatgtgtgatgggcaaggtgcctagaacataccaaatgctcagtagatggtaggctgcactgcatcccattaaccgtttgcatactgtgagctcccagctacctccctttatctatttacccgtctccatccattcattaatttattcatatattcttccattaaaccaattactatcccaagccagttccctgttaggcattcattctacagacagacataaatcactgttttttccatcatgggactgtgagagctgaagaaggtgacagatgtatttacgacagactgcaataagggcagtgataaaaaacagtactggggctatgagtgctcagagaaaagagtggcttgctgggctgcggctgcggtaggggctgagaaaatgcttcacagagcagatgctgaggctggattttgaagataaacagcaattttttgcctggagagaaagggtggggaggaggaaagggcctttcaggaagaatatgatcagcactcggacctagaaagcaaggcatactgggggaagggagaaatggcccatgtgctggaggctgtaggacacaatgggttgggggtcaggagtagacagaggcagggtacagcccaggctaggagggagccttgtgtagcaagtgatggcaacttttaatcccattaaacaatatgcccttcatcctattggttcttgcttctataacaaggtaaatgtatctctgtgaggtaataataccgataaaaataagactaataatcatagcaatgatcagaataataaataacacaataaaagagcacatatgttcagcatgcaaatatgtctggctctgtgctaaatgctttactgggattatcttattctggcctatggaaatcctttgaagatggtagcattctcacccccttatagttagttaaatcatggttcttcttcctgggacatcaatattgtatgaggaattgagcaagtgttaaattaattaactgaaaaatactataacttaaactaaaataaacatgcatatactatgaaataaaatggcatgatcttttaaaagatgaacctgaaatgtgaactttatgacagattcttttgagcacagctgcagaccctctgggggtaagttcattttcatatgcctttaagaagacttcatttcaaaagctcaagaggcccccagtgcaagtgacagaaaatcaggacaatgttctaggtgggggaggaacatggccaaatttactgtgttttcaaatgatcacccagctgtcagggtagagcatgcatttatcggtgccaacgctgctgcaggaatctggatgagggacaatgagacctcaaccaagctagaggcagtggctcaggaaggggaagatggatttatgagacgctgcaggccaatgggcaggacttggatgacagtgattgtactagctattccttattgagggttgaacgtgggacaggcactgggctaagcatctcttgggtattaattcacaacccacatgtgatgttggtattattagcactatttccagaagggaaaacagagctcttattaattagcttaagagcatttagttagtcaatggtggaattaaatttcaaacacaaagtcccgctttcaaaaaccgctacctaaactaaataaacctatggaatttcttctgtacatccaaagaaatcttcctctgctttatttgaatgccactgtcctttatactgcccataagatgctggggagtggctccttaatagcagcctcataaaaccccagcactaacatgaagtcagaagttcaaacctccactatccttcctctgtctggctaagaatgatgcacttcagcctccaccaggcctctcaggaagaaggcatagctacaaaaataccttggagctgcttttaaccatgtgctcaattccatggcactggttctcggctacccattccatcttctggaaactagtgggcaccgtggcccggggatgaggcctaaggaagcagaaagagggcaggtgctcccaatctggaccaggcagcccacggcaacctcaatggcaggagagggcagaaacagtgaaagacagaggattcagaccatcctatttgggattttggaggctaatggagcatttccaaaattctgttcctatagatgcttctgttcagcaagtcattaataaatgttccaatgggagaaataagagtttgcagtcaacatagtatcaatacattgagttaaacaaagcagcctagctttctgtactgcaggacttctcagagtttttaatagactaagattcattcaagaatcttcaagagaaagagggagggtggagaatttccaaacttttttttttttaatcatgaaattcttttgtccaaggaaatcttgatgggctgtcttgggtaagtttggaagtatagggctgacatatactgtccttactcttctcctgcagaaattgtatcccatggtagcagcaaaatcacaagcatactgtgattaagctgttttggaaattgctttaatagcatccacttgagcacatttactgtgctacttgtcagtgagtctaagggggaaatagaattctctgggcgttggtaccaggaggatttggtttatcacagattcctcttgcaccatcaatatgagagctataaagctgagccattttccagtgatctttgatgttaatacgctcatttactcaactaatatttattaagccatttctatgtgttagatttataaatatgaatcttatattttagagaggaggatagtagacaagcaaaaatttaaaattttagtctgaactactactgtggaagaagttaaaaaaggagggtgacgtaagagatagtagcaggttggggactgaaaggagcaaaactgtagattgggtagtcatggaagttggtttttaggagctgacatttgaaaggcgagaaggggctggctaggagagcagctgggggaaagaaagaggcatggcaaggagaaggaggaacaagttctcagatgctaaagaaggaaccgtttgctgtgttggtgaaacgtgaaggaagccagtttggctggagcacaaggaagtgcagagcaaatgatgttcgaaaagagggcaggagccagagccagatccgcaagccaaggtgcagagcttggatcatagtctaagaataacagaaaactgtcaaaggattttaagcaggggaggggctttctctggtttatctttctaaaagattgctttggtagttttgaggagactgaatgcaaggagagtatagttgtaaggagcagttaataaatgacagtggtcatgatggtgacaaagaggaaggacagatatggaagagatacaaataaatttcttcatgcatagttttctgagaccccatctaacttgtaaattaacttaaaacagacttttattaataatctgactatgaaattcttctctaagaggggaaacattttaaagtaagtggcaagttttatgcaaaaatactttctatgtaacattgtttatcatgatgaaatattaggagcagcccaaatgcctaatagtaggggcttagttaagaaaattatgatgcataaaaataatatttttgaaaaattcattgacataaaaatgtttagaatgtgatgttaaaaaatgaattcaggttggtaatgaagggaggaaaggctatagacttggagtcaagagtgtttatggaatatgtatgtgtggagaggacttaggagggggatttctggtgaatgatacagaagtaaagatgaataggtaaagctatacgaaatttcaagtaaccctaaatgccttacccagaacaaacataagattgcatgtattcattccctgatgcatgccatctgaactttccaaggtggtctacattcagccttttatcaggtcttcacaataatcttctgatgtagggcttggcatcctcattttacagaagaggaaactgaagttcagggagaaccaatgatacttccaaagtcatgcaagttaaaactgacttgggctgggattagcactcagacctgtctgactttaaggtgactgctctgtatcactacaaaatggtttaaacctggggtttcccatatgagttccaaaaacgaattccatcattttcttctgcctcaatttgtgatctgacagcttaacatgtagagcttggttttttacaggattcaagattttacaagattaagaattagacatcctctcaacagatagcaaacatctactatgtgtcaggcactgatttaggccaggaatgtaaaataataagacaatccctaccttcaaataactctctgtctagctaaggaaagagccagacaaaagacaatgatatcacacaaaaatgaatctagtgcttaatacatgtataaaggaaagctgggaggattcagtgaattgtgactgtgacaatcaacaacgtcttcatagaaatgtgccatgcatgttaagcttgaaaagacaggtagaatttcattagtgtatcaggttggtgcaaaagtaatagcaccaacataatagtacatagtcgttaagttaaaaggtttgagactcagactgccaggttctccctggccccaccacttactagaatgtcccctcagacagattacaatagctgtttgtaccttagtgaaattatctgtaaaatgggaattaccactgtacctgcttcatagggttgctgtgaggatcaaatgacataagatgcatatatcatttaagctgtttcttggaataagttaagagtcaataacccttaggggccagagaggtggtttcatgcagagagcatggcatgggaaacagcactgaggacagagcacaacaatctaggaaagacagtggagaatagagctctgtgtggctttgagtgtcatgttcatagcctgaacatgtgtgaaggtgctagataaccactgaagctgtgggaaaagggggatgacctgatcagagccaagttacaggaaatggagaagtgagaggcaagaagaggagactactagtttttctatctactcagctagagactactgagtagatagaaaaaaaaatggtttggaaattaagcagtgacaagttgatttccttcatatacgaagtcacatagatggtagaagaagaaagaagggatgaagagaaggaggaggaggaagagaagtaggaggagatgaagatgaaggaggaagagatgtagaaggagaaagaggaggaggaggaagaggaggaggaaaaggaggaggaggggaggagagaagagaagagaaggagaaggagaaggagaagaagcagcagcagaggaaaaggagcaggaagaaaatatctgctttttaataaatgctgggttaggcactgtgctgagttattcttacaaccctgtgagacaggagtggcttggagaagtagagtgatttgccctgagtgacatagctaggtagcagcagaaacaaaagttgaattaattctatctaatttacaataccactcttgatcattctgttattcagcctgctaaaaagtaggcgcagacccctgtttctggctcccagactgaggatgtctcctactagaatgttctgccactttgtactctctgaccggcaacaacttaaagaacatctactttgcagaggtcctggtgctacacactttccatatatagttgctaatctcaatcactgtaaaatttatactatccattctcattctcagttgaggcacctggggctcagagaggttagctctgggtgtagggagcataggtctgcagcctccaaggggatttatcagggagaaagtggcacaagttttatgagcacagggaagcaagggaagaatgcacagatctccctagcatctttggaatcagaggacaaccttctgacttcctggccagatgtgccaggagggcctacctcgagacttgctcctccgcttcctcttccctgccgatgtgctgcgcaggggtggttgcagctgaccgatctcgatgggcgtgttagcgcggaaactctccttgaacttctgcatcagggactccactgtctcctgagtcgcctcagctgctgctataaggtagcaatggggctgaggttagggcttgagcccaccctcagcacctagagcactggggctgaagttagggcttgagcccaccttcagcccctagagcactagacctggccaccctaattccttgaaactccctccctgacccattgaagatatagaatcaaaaccttgcagtctaactgcagatgtatctgttggattacatacttatgtattcaacatttactacgttccaggtactgctctaggcccttgagactagagggcttggtcgtgaaatgtgagacacaattcattattcaagtaattcttagttcagtaggagacatatccagacaattctaacattgtgcaatatttttgcaatagaagagtacaaaattccaaaggatcactgaaaagggtcatcacacccatctgagaatcaaaataggcttccagaaggaggcaatatttaggatgagaccttaaagatgagtaagaattagtaaagaaagcaggatcagggtgaggttggacagagcagagaagacagcgtcctggatggaaggagaagcatgtgtgatgatctgaaacgagaaggagcacggatgcttgagcattggaaagtaatttatggtagttacaagagagcttgcaaagaggaggcttatgggagatgagattggagtgataaagacatctggtaggccacatttaggagtataaattttatcctaatggcaaaaggtatcaccaaaaggttttaaacagaaaatctatgtgttcaaattaaatcactttgaaaacaatcactaactaaagtatggagaatgcaaactgaaggaggaaaggaggcctggactgaggctttggaagtagccagtcaaaggcaatggtggtctgaaccagggcagtggcagcgaaggtgacacaatatcttaggagacacaaccacagtactgtggatatgtcgatcacttagcaacatatacccattttattgaggggatgttgaagccccaaaacacaatatatgtcttactccaagataggaaatggcagagtcaagccttctaacaccttgtccaatattccgtttgcaccaataccttccaatgaattgttagtagccacatttccaaaaaagtttcaaagttgaaactggtagaaagttcagtacatggagaaagtaaggtcagaagggcagagagaaaaagttggaagataaaaggaaaaaaataacagaaaagcttgagaaggaaggaggcaacataaaaggcaagaagagaaaaccaaaaagaagaaaagaaaaattgctgaatagcctcagtgcctttgttctgagaaattcccaaagacagccctgactttgaaatcttcaaactcatccctccctccatctgtgtctccagaggctgggaaatttcttcttcagtttgagctacctgctgtctgatgccaagagatgggatgtgccaacaatttctgtttctttgaaggggcttcatcagactagacaaagaaggctcctgaacaacccagtacccatttctaaggcgctcctgttttctcagggaagcttatcaggttagacagatgtgtctgcagagtaagtcagacctagagggcttgttctggtattgggttctgtgagaagtcccatcttgagggttatagggaaaaggtatgattgctaaggtaaaaagacaattgacaatacaaatgaatcatgtggtggcattggtttcctcatctgtctcccttgctatctctctccacagatatcttaattaggtgtacttgaagaaaccaagaagattccagacatggggtcccttcttcaagcctgggatgaagaatccttcagctatagcctgcagtatgactctgagaagcaatgtcatgccaagttttgattccgtaaacccagagagaaaagtgctttgcccaatagatgggctatactttggtcaaaagtccagaataagccacagtttggaatcctcgaagggaatgacccacacaggatctgtcaatattcattcattcattcatttctccacttattcattgattcattcattcaacagaatttacagaaaaaaacattacataccaatgctgagaaccaaagacatagcttagcttgggctaccataacaaaatatcatagtctggttgtcttaaacaacagacatttatttttttcacagttatggaggctgaaagtccaacatcagggtgccatggttttggtgagatttctcttcctggcttacagatggccaccttctcctccctgtgtcctcactcggtgggggagcagggaaagagagagagaaagagagagagaaaaaaaaaacctctcccttcctcttttgataaggccaaagttcaatcagatcagggccccttcttatgacctcatttaactttaattacctcccaaagatcctatctccagacacagtcagccacggattgaattgtgttccctccttccccaatttatatgttggagccttaactcccagtgtgactgtatttggaggtgagggttttagcaggtaattaaggttagatgaagtcataagagtgggatcccaatctgataggataggtggccttataaacagggtaagaaagaaagaccccactctctttctatggacacagactgagggaaggctgtgagaggacacagtgaggggtggcatctgcaggccaggaagagggccctcaccagaactcgaacatgctagcaccttgatcttgacttttcagcctccagaagtacgagaaaataaatttctctcgtttaaggcacccagtctacaggttaagcttccctaatccgaaaatctgaaatccgaaatgttccaaaatctgaaacattttgagcatggacatgatgtttgaatgttattctctaaggcaagcttgtccaacctgcggcccaggggccacaggcagcccaggacagctttgaatgcagcccaatgcaaattcataaacttccataaaacattatgagatttgaatttcttttgctcagaaggtagagaatgattgataagggaaaaggagggattaaggatgactcctgggtctcctggcttgcacagatacggatgacagttcctcagtaagaggaggaacactgtaagagatgacatttgagaggagtgaacactagtttttttttttttttttttttttttttttttttttttttgagatggagtctcgctctgtcacccaggctggagtgcagtggcgtgatctcagctcactgtaacctctgcctcctgggttcaagcaattcttatgccccagcctcccgagtagctgggattataggcatgcaccaccatgcctatactatatataggatttttagtagaggtggggtttcattatgttggccaggctggtctcaaactcctgaccacaagtgattggcctgcctcagcctctcaaagtgttgggattacaggcatgacccactacgcctggctctttttttttaaaaacttttattttagactcaggggtacaagtacaggtttgttacgtaggtaaactgtgtgtcatgggaggttggtgtgcagagtattttatcacccaggtaataagcatagtacttgatagggagtttttctatatggaaacctcagaatgtctttgagacatctaagtggagatgctgggtagacagtgagttatgtggatcacacatgcacaggagagagctggacgctctggagactcaatacccgcattccttggaaaaggtagacagtgaatgtgggtagtggctgagaacatgagcttctgtgctggcagagcagaggcagcagaacctgtactcattcctagcttgtgctggctgttctccatttacactcccagatccacccttcaccctctgggctgtgtcacccgctccttgttagatggctactagttgggtttggcccgtgggatgccccagaaagatatgggaggaatttgaaggtatttctttccttgttcctttcctgtttcagtaccatgtttctgacagagactgagattctcaacaattacagctttctgcccagtgtcccttttccacagtcccagttctcacagggtccaataaaaccatgtctccctgccttttcagttctaggaatcagtagtggcttcctgacattcttgtcctggtaccttgaaattcctatgttgattctttttactttgcctacacctctataaatagccacttcattgaattctttttaaaaaaatcccatttgaagatgtgttctttgtctagctgggaccttgactgatatatcattcagcttccctctcttttttttcatggctctgacattcagcaattcctaaaggtcagcctctttccattttgcaatttctgtcttctttcttctaagctgatacagatttgagtggctgggaaaagaaggcacacagagaaggaaggggtgatcccctgagctgcaagggtttctaatccccactgtagcaaatcccatccatctgtttggctgctcttgcctcagtgacagtgccaagagcccaggcagacttagagggggaagtgctttgcaaacctctccatggccaatttcatcctgcatacaactccccctatccctgatccctcccgaccccattcagcagctctatcgatatcagtatatcaagttgtccaaacaagccacattacctcctggtacccgctgagctctgactccccagagcggcaaaatgctcacccatcgcctggatgaatgcaacagatgctgcttgatctgagcatcgcggcaggcccaggaaagggagggagaggaggggaacactgcctctttctaattgacatataagagattgtcaagcttaatggtaataaaccactggggcctgaggaagaaagccctggtccccaagccaagctagagagagaggacaggaaaggaaaagacaggatggaagaggagagaaaaaaaaaaaaaaaacaagaataaaagagataactgtgctcagtaataaagaagagaagacaagaaagagggggtctaagatgagtgggaagaagcagagaggcagaacacagaagggaaggactaaaaaggacaggcgaggagacatggaaaagaaaacaagaaaaagaagaaggcatagaagttcatggtgagggatacaagactacaaactgggttcagtgtataccgctcgggcaatgagtgcaccaaaatcccacagattaccattaaagaatttactcatgtaatgtaataccacctgttctatgagaaaaaaaattaaaaggatagaaggactaagttctagtgttctatagtgctgtagggtgactgtagtaaacaataatttattgtattttttcaaatagctagaagagaggattttgaatgttcctaactcaaagaaatgaccaagctttgaggtgatggatatgctaattaccctaatttgatcattgcacattatgagcatatatcaaaatatcataccgtaccccataagtctgtacaattattatgtgttcattaatattatttttaaaaataagggataaaagggggtggaccctgagtcattttgcaaaggcataagtgttgtatgggtttccagataccaggcaagccttagcttctaccctggagaagaggcactacacattatgtctacactgatactcaaaaactgtacacttaaactgtatatttaaactgtcatcctcaagacaagcctggccaacatgatgaaaccccatctctatttaaaatgcaaaaattagctgggtttgatgcaggcctgtaatcccagatattcaggtagctgaggcagagaatcgcttgaacctgggaggtggaggttgcagtgagctgagatcacgccattgcactccagtctgggtgaaagagtgagactctgactcaaaacacacacacacacacacacacacacccccgttatccaccgttctcttcccccacgcaaccacccaggacgttccaccgatgaaacgcatatgggtttgagttgaagttccagtatcactttgctcgccctcttcaattttttcagacatcatcagtctgtgacataagaaaattcacatttcttgagcaccaactttttgctaggtagggagcctggtatttccttatggtttctcacttgttccccctaacaacctggaaagttaagtattaataatttctgttcagagatgaggatagcaagactcagaaatgttacatggtttttccaggtcatgcagcttagggacgatagaactgggatttggactcaggttatggtgactccaatgctctggccttatctgttgctgcactctataagtactccctctctggttggctggagatgggtatgttaatcttggagtttggatgtgacatttctgggcctggatggtggctctgatagcttagctcctcttcagatcatctaggcaaagagccctaggaaatctggtgctgcctgaaaccagtgagtggcttgacttgattggagattagcctgttatgccagtggacccttgctcaagactgtccaccatggaggttccagggttgacccatgtctcactgcagaactgtactaagagaaccaagaagcaaatggacattgaccatattgcctagtgcaggtgagaaatctcactcgagttccagtatcaactctccatgtgcatggccttgagttacttctttcacttttgcaacccctggtatcctcctctgtaaatgtctgcagggttcttgggacgattaaatgtaattatgtacaaaaaatgtctaacagagcttctagaacatagtaaatgctcaagaaagagtagtcattactcatctttctctcactaacctgtcagcttcatgacatttcatttaactcattctttctcattcattttgaaatttttggtgtcataaaatagccactttgcaaactttcttagaaattatacattccccctttcattcaaatgtgaaaatagaggcaccaagagataaactcatcataaagttagcagcagaccaaggtctagcactcaaatctcctattccactactcctccctgctttcccaagttttaggataattttaacctcagatctgatagtcaattttgtgcgccaatttactaaaccatgatatccaggtatttggccaaacattattctagacatatctgtgaagattttttatctatatttttttagatgacataaacatttgaatcaataaaattggagtaaagcagaacattctccatactgtgcatgagcctcatccactcaagtgaacaccttgatggaagaaagactaacctctctgagttagaggaatatgctacctttggacttgagccgcaatatcaactcttccttgggtctttagcttgctggcctaccttacagatctggaacttgccagcctccacaatgacatgaaccagtttctttcttttttttttaattttaaatttatttttatttttattttttttgagacggagtctcactccattgcccaagctggagtgcaatggcatgatctcagctcactgcaaccactgcctcccaggttcaagtgattctcgtgcctcagactcccgagtagctgggattataggcatgtaccaccatgtccggctaatttttgtatttttagtagagacagggtttcaccatgttggccgggctggtctcgaactcttgacctcgtgatccacctgcctcagcctctcaaagtgctgggattacaggcatgagccactacacctggcctgaaccagtttcttaaaataaatctctggttagatagacagatgaaaggaaatagaaggatagagaatacatataactaatagggtgttgtgtgtgtttgtgtgtgtgtgtgtgtttgtgtgtgtgtgtgtatgtgttcatgtcttcttggttctgtttctctaaagaactctgaccaatgcaacctcagtttgtgtcctcgggctttggactttgcacagtcaaatgccaggactggggacaaggtgataagagaagacatcttagtcctaaggtacacctaagctgggaagacccaacataaatgcaaaaaaaaccatccaatttggaaattgtgagagtccattcattgcatacaatattccatcttatataggagtcaccttttcctgaaaatactaagaaagaaaacaacaagcaactagcgttccttaggcagatgagaatgcttcatgactagaataaatttaaaacccaagcacacatttttaaaaaatggctccctctttccaactctcaggggtaaaaattgatggattgaattttctctcattttagtttttcctcctgcacattttcttaaacctttggtgcctggcatagcttatcttcaagcaagcgtctgcagacaagacaaatgaacaaaaaggagcaaatataaattggaaaacttgggaatagccttttcttatatacaagatcttgggcctgtcagttaatactgcagacttgtagggtggtcatgatttctgctaggagaactgcattgagtttgaatgatggaattaaatttagcgatatttttctctgttctgttaaaaacacaataccttccaggttctctggagctggcttcacagtccctagccagaacacagatggtctctaagattccctccggttccatcatcctgtgttcctaaatgtaaatgaatgtgctttcatgaagatgaatgcaataaatacaattgcattcttcagtacgcaaaacactttcacctccctcaactaatgttatccttacaaactgaacttccacgttacagagaccagaaaggtaatggacatcccaaaggttgggctggagttgatactataggcccacaaatcctttttgaggaaaaaagggtcaagtaagtagacatcttcggtctaaggcttctgggtcacttcattaccaccttgatagcaatgtgcaggaagcgaaggctttgaaatcaaccacagtctcttaccagctgtgagacttgggcaaataacttaacactcagagtctcagctctcctaactgttaaaatgaggcttgcaattccaaatctaataagctggtttaggattaactgagatgctaaatgcatatcagagtgtctgatacagagtaagcacattttttaagagacaagacctcattctgtcacccagactggagtgcagtggtgcagtcatatagcttactgcagccttgaacatctggcctcaagtgatcttcctgtcccagactcctgagtaactgggactataggtgcatatcaccacgcctggataattttgtttttaaaattatttgtagagattgggcctcactatattgcccaggttggtcttgaactcctggcctcaagtaatccctcactcagcctcccaaaacactgggaatgcgggtgtgagccaccacacctagtcagagaatgagtacatttttattgtgccaagaaaacatttttaaaaagagatggagtctccctacgttgcttaggatagactcaaaccccttggctcaaggggtcctcccacttcagcctcttgagtatctgagactagagacatgccaccatgccgtgctattgacaaaagaaaaaaaaacaagtaacaaaaatcttaaaccattagtcatatagtcatagcaaatccagattttctgctcagcatggacagtggaatccaataatccaatgagaatcagagtcactagccaaattcctccctcccagatctatcctgtccatgacttcagaggaaggccacatcatatggctcagaactccgtgggagtagagccacctataccttacaatggagttcttcattcaataccgttagtggatgctgtatccagggccaggcactggggacacagtgataaaatgaacactgtccctttttaaaacaggacactgtttagtggaagagggaggtaaagataatgaaaacagagtgtgctaaatgcttaggtagagagcaaagcatcataatactgagaacctgtcttctaactccttttgcaaggagaaaggctatgagaaatttccagagaaagtaccaattgctcagagccttaaataaaggatgtggaacttgggaaagatgacagaaagagtattatgagcaagagaaaggggcaagggttatacagaaagttccacacactttggttcccctggagcttaaagtgagagacaattttgttaccaagagaattcatcttcaagctaggaaagagagcctgctgttttctacccaatcttacttctcttccaagaccctcatttaaaaattccacttcttttcatagccctactgcctggccccactctcctttctgacatctgttactgttatcccagataccctgggtgcagcgagagcagagtgtagggatctggacagacttgggcttgagccttcattatatctcgaactcattatgtgactttgggtaagttccttaaattctttaagcctcagttccttctctgaaaaatgttgagcataaatctccctcaagaattgtggggtttcttcttttggtagtgctaaaattcaatgtaataatataagcaaagtgcttaacacactacccaaactggattaagcaatcaactaattaaagcatttattatcattattgttatccggcttaacctagataagcctgcggagggtcttgcacagagtcaaagctcaataaatactaagttctccatttccctttggggtaaccgatcgcctttgactcactgttgtcctttcatgttcaaattttactatccttcctggatcctgtaacattcagggttttcatctccattctacttcatccagtcccattcatggttacaccttggatcttgccataatttggaatctggatgtggctgcaacattaattccaaagacacagcttctgctcatggtcttctgtctgctctcatatcttgctctttcatgcttatcaagtttctgctttgacctccaaaagatcaccaggtcctgaatttaggcatattgtgtcaaacacttgggaaaatataaaactgttgctgacagatttatattaaactgttacatgccagaaaaaattgtttttccagcagctagttggaagaaaggggagaaccccactctcttacttttaattccttcctttcttgaaattttacttcctccaagtttcacttcttccctaagaacttgaagttctcaggtgatttgttaccaggattcatctaaatgtaccattcctattttccaagtctatctcagtattcaatcacaataacactaataacatttactgtttatggagtgtttactacatgacagttattagtttaaggtaaatacagccatcattttatgtaatcctcataatgtccatggtacatggaagtatctgcctcatttttttacccccaatttcaaatccacattgttgctgcctcagtatagatagagtacacttcattgccccttgacttgggcttggctgtgtgacttgctttggtgaatggtatgtgtagggaactcaggatgtgctagttatgagcctgggcttcaagaagcatcacatatttctactcccacacttgcatctgacaccaccaagaggaaggcttgtcgcagctagtgtgctagatgaagaaggaagaatgactcagggtagactcacagctctgcagcatggagcagagtcaccttaactcctacagcctgggtccttgaccctagcaaatctgtaaatgatgagcaatgcctgtgagatgagaacaacacttcattctatcctcctttctatcctcagaactaatcaatatttattatttcaggacactaagattctatagttgtttgttacgtagcattgttgtggcagtgactgactgaaacacaacccttcaagatacatatcattatctctatcttataaatgcgtgagtgaggcaaacagagcttaattaatttttcaagggtcatacacaaccttagaatagcagaactgcataaatatcctcaaatactactttagggcttattttgcagtgggaacaataaacatgatttaataaattgacttccatacagaagagggtgaaataaatggtcctcctcacagccacctttcctttagaccacattagtgataattgtgaggatgatccaagaattgacaatcacctgaaactagaggtatccctcgtcagtggcattagagactgttaacacatccattcacagtttttagagttgagctatgcttgccgaatgaatgaacacatgtttccaggcatgtatgaccaggcactcaatgaagggtataaaaatatgcattgtgacaagagtatattacttacccataatatggctgggaatggggatgaggagagagcagaatgtggaatctgtataaattctcactacttcaactgtcagattttccacccatcttctttgaaactaaggcaaatcttcccagtgcaatagggtggttataaaattaaacatatgtaagtcaactataacgaatggcagggatgttagagcaaaattaatgcagccacattataaatatgtcctatttctcaatattaaactcttaaaaatagactggctaaatatatagacaataatggattgaggctaagttggcgttactatgaggcttgggattttccatttaatggcttataatttccatttcccatttctacatgacagtaagagcaggctggcttcattattcatgattacatgccgtcaccatcaacaaaaacacaagcaggaagctagagagtaacatttggggtgtagcagaggatcctgaattggaaactcagcagatctggaagcagaagaatggcactcaagttccatgttagttgctgtgtgactttggacacttcaccaagcctctctcagcctcaggaaattaaaactactgtgacatgtatcttaaagcatttggtaagctaggtcattataaaagtttgcaatattatcacttcatttttactagtaaaccctagttacaaattctgcttaacacatccttaattaaacagtatacatacaaaaggatgagataaaacaaatggttaaaacatgtgaaaaattattttattattatatacatcaaggtccaaatcctggttctgcctgttagcatctgcttacccttgagtacaatgacattgatgttctgagcctctcagttgtcctttgtttacttaatggggataaagatatatataataaggatttaaataagaaaactgtaatatcattcactcattgtgtgtttagtgtttactctacaccaggcaccattacctcatatgccactcaccacaagcctaggaagtgagtgacattatggagagagcccatagcttgtctgacttccatgatcttaaccactctgaaatacaggaagaggagcaaaagaagagtgtggagggaacagagaagagatcaaactgtggagtgctggactgtcccaagcatgtatggaggctgctgtatagatatggggtcccatatgcatcccagaaattgtttctatcccatggtagataatcctgaattgtcttcttcttttccttgttttggccctggttaaaactggctcagctaaatattatagataactcctttcttctctatccccttcccaaacagcagccaaaaaactgagctaaggcagtagagaggacaggaaatcatgtcttcagcagagcagaacaaattccttctctgatgttttttggtgaaataatagagatccatcctagggagccatttgcacagggagcctgcatgtacgggtggacgggtcttgaagaatgctcttatattgctaatgtgcacaatgaggtagagaaatgtgataaaaagaaagagacagagagagagagacagagacagagacagagaggctgtgatagaacctcaaaaccaagcccctctctgtgcaacacaggagactctgataacctcagaaggaagctcacactccaggcactgttctgataagggttacagactatcaagtgctatctctcttctctgagtatcctcctcctcttccttatcctttatctgtcacctatggatttaaagctccagacattggacctgaattagaggtaggtttccaagcagacttttttgcagtccacaccaataatgtagattttataaacacattcaactggacatttttccttctctcctaacttttcattcaattatctgggcatcagagagatcaatatgagttaacagtaaggtgaccactaaagtctagaaccaagaagagcacagctttactcttcattgctcagaccatacctaggagtgtgttgacagatgagtgttacattaagcatattattaacagagcagagtaggtccagatatgagaagctagtctgacatggaagattgtaatggtatcatgaggaactacaagactctaagggagtagaagttagctgccttcaattaaatgaagggctatagtactagcaccacttctaatattaatgtttaacatgtgtattgctatagctgcaccccaggctccacgatgcatgcattatgtatgttataattacaagaactagtatcttttgagtgcttacactgggccagacatctgctaaagggttttgaagttataatttcatgacattctctatgatgctgcaaaacaaacactatttataactctctttaacagatgggaaaactgatcctgagagagattaaggctcttgactaacacagggtttctcaactttggcactattgacatttgaagctggctaattctttgctgtggaaactgtctgatgcattgtaaggtgtttagcagtattcctggcctctatccattagactctagcagccctctccccaagctgtgacaatgaagagtgtctctagatactgccagatgtccattcaggttgtgaaccaatggactaaggtaacaactattattttatgaatctacatctagagattcctaactaaggaaagaagaccatgaagaggtgttaactgggtgcaagccggcagtgacatcactttgcaaaaatgaaaacaaaaaacccagaagagattaaagcatttgataaacgtgaactaaaaggcaggtcagaccactgacaatgcttcaagtccattatcctgtgaatttaaaacttgaggttatttttattctgttttgcagtaactgtggtttagtagttgtagaggaagatgaaaatcttaatttgaaatgtcttctccttagcagaagcctgaagaaattcaccttgcctcaacatgtatgaggttaggaaggtgccactcccaactccatttattcactcctccagcacatacacacagacatacagacatacaccctcttgtccatgcctctgggctcaaaaacaattgatctgattcgttatctagctctccgcagaagaaagctgagatacaatagcaagtcatcagctgtgcagcaaattggcaagtttccactggtttgtaataagttaatgatgcccaagaaaggaagacatagacaggagggaagcccacagcctcccacctgtctcttttcatggccagaacatctatcccctaagctgtatttgaacacagaggagggaagcagaaaggagacatgcacatctctagcaattagagactggaaggaaaaaagacacatggatccaagttagcaggaagcctggtggaagccaatcatccaggtggcatttcagagtcagtcctcaaaagagcctcatgcaaggaattataccaagatgaagttaaattaaagctggactgagttgggctggacatcaaaatgaattcttcaattaacttatatgactcaggcactgaaataaaaatgaaaagggggagaatatggacttccatatccagaaagccaagtcagatctatctgtctgggtgactttagccttcatctgcaaaacagggactgaagcaacacttggatgttgagtatggtatatcaaagaagaatgaaaggttttcttaggtggcatacataaagatgcagaagtacaaactcattttcagttcagaaactgatgagttatttagtatgactagagttcagttttcctatagggttggtgctatagatgagaaggagcgaatgaccccatcgtgatgaggcttaaatgccaagctacacatttgaagtttagtctgtataacatatataagaagactttcatcagaagagtgacactgtcagagatatacttaagaaagatcagtgtaactataactatggaacaaggatcttagggaaaagaatgcatcatgataataatgatgaaaagagctgcaatttattaagccacatggcatgtattggcatttagcacagtgccagtaactgtgctaggcattttacctgaatttcccaatttaatacaacagtgtaaggtaaatacttatacaaaataaaaaaatagaaaaaattaagcctataattaaagttgtgctcaaagtctcaatagtaattatacgtgtagtcagggtactaacccagttccactgctagtgactatgcatttattcaaataaactgtgcaagtccagatacaaagatacagattttgactatagcagtatcaaaggaaatagaaaacaggacatgcatttagaaaagatatgtttaggggttagaatgggcaagaatgaaaggacttagatatgaattggaggagacaggaagaagtcaagactgcattctaattttcccatttggaatgctatataagtatgatttgagagttaactatatcccgatatatccagaagttggttggatgttcccctttgcaattacagacggatgacttgtcattgatatgttccttactatgatcaacttgtctacagaactaaatcaaaactttcaccacagaaaattttaaaatgtcatggcatgaataaatttccacatttccctatcagtatcagtgagtgcatggcagaagggcattgggtgaggccacgtcctagactctgggattttgtcaagactagaagattcaggcagatagccaggaagaacactggtgaaatgtgcaggggggcttgtggaagactgaacttgaaactttggtaaacaaaatttatgcaaatatttacactgtcctattaaatttgcttatcatgaatctctctgtggctttgacctaccaggtaagtcaaatccttgtggtctcactgcttttctgggacaacagacattgcactcactctgatcttcactgcttgcccaccttcagcaaagtctccatccctttctgcatccttgtcctcttggatgtacctggccctccctacctcatcctctctccagtcacagtcctcattcacttccaagctaattgtctccactggtgtatgcaaacgaaccatttatgggaaatgccgtggaatgttaatttcatttgaaattgggtaattgcaaaaagtgcttccacttttttattatatagaatgaataagtattgtattaatagtgccatttccaattatgaccactatcgcaggcctgtcgtctgctaactgtgggttatttttcatggagcatttttctgaacagtttttttaaaatccccccttctttgcaccattgtaattaagataatgcagaataattataaaaacattggaagctcaaatgccagcatagactatccaactagtgctgcatgcttattctaatttctcaagcgaaaaagaaaaagtgttggagtctactgaggaaggcggatgaaggttgatgaagtcagcaagaaattggccagaacagctcagaaaacctggccagagcccatgtgtggggagctgagcttgattagatatttctagaaagcaaccaggaagtgtgctaaagatttttgggtattgaaaaaatatttattgagcatcaattcattattgagttgtgtgccaccatgcacagctaaattttgtgcatctactgtatatcaggtgcttgatatagatgatctgatttccccatcaagacaacttcatgagatttgttttttattaccatttgacagataaagaaactaaaagtctaagacgttaaggaagttggacaacttgaaaaaccagaatttgcaagctgagatttaatcctcgattctactcttagctagttatggcaattagctagttattgctattaagaaccactccaaacaagattgtattcatcaatgtgtttgtgggtaaagtggaggtcagattagtctggctaggctcagttttgctccaagctgcagattgagttcaggtttacttcatgtctcacatcttctttaagccaatggactatgtgggacatattcccacaaagatatgaaagtcacaagaaggatactccactatgaaaatgcatttaaggccttcgtttgtgtcctacctacttacatcttaatggtcaaagtaagccagatggccaagctcaacatcaataggatgggaaagtgtaccctgcccacagtggccaatggggagtgaatatttgccgaatggtaatccaagctattaaataacatacctataaaatgtttcaagtttctacaacaccatgaaaatcacacaggatctaagttcctagggggcaggggtccagtcaaagggaggcatctgtggtgacacagaagtggtatagtattatgtgacctggagcaaggtagttcctcattgtcacttttcccatccatataaatcacaataacacaggaccaatctccctaaaaaggccactggagggtaatcacaataacacaggacccatctccctaaaaaggccactagagggtgactatgatgcctataacaagttttaagaaatggaatgcttctttgtatgctcatgtcctatcaacttgttctgctttattcttcattaaacatattatatatttatttttattatttttcctcccttgagtttccaaatgtatgctaaatgaatataatgactttctatttcattaacttttatattgcccatacctaaaacactgactagaatgtagtaggcactcagtaagatttcttaataagtgaaatgcaaggtgtgcaaaccccagcttataaatatcctgtatatgtaacacaaagaatgatacaaagaactgaacttgcactaactaggtactgtcttgactctgaagaaaggacaaggttttgtgagagacacagtgggatgatgaagatcataatgggaagagatggtgatttcatgttggtactaatgataatggaaattataaagtacacacacacacacacgcacacatacacacacacaaatggtccctcaacttgaaatcaaaagtagtgatgacattttctgagctgtgaaattttggcagatcttttaaccactgcaattctcaagggatcttatctatgtaattggtttaataatatagactgccagaatatctcaagtctctgagataacatgttaaagcatctgacacaaaatatatgtagctaccaggatgatgatgatggtggtggtggggacagtggtagtggtaatgatgattagcattctcttaccatgttgtttttcttgggaaaggaacacaaaaataactcttgtgaaagtaaacagaattaaaaccacacaacagatacaacaaagggctgggggttaaaagtgagagaaagcgcttccattgaggagaactggagcagctttatgaaagaaaaggcgttttttttcttttttcttttttgcaagacagggtctcactctgtcacccaggctagagtgcagtggtgcaatctcggctcactgcaacctatgcttcctgggttcaagcaattctcctgcctcagcctccctagtaactgggattacagttgtgtgccaccatgcacagctaatttctgttttttaaatagagacggggttttgccatgttggccaggctggtcttgaattcctgacttcaagtgatctgcccaccttggcctctcaaaatactgggattacaggcatgaacccctgtgcaggctgaagaggaggcttctctaaagactcttaaagactatgtaagattcatatatggggagatggaagagcaaaattctggcaaggggaaacaaagcaagaaaatctacagagagagaaaagggcacaggtaacagttacaactgtccaaacaattttcacacatttttctttttctttttttttagaatctttagatttatcttagcaattccagagttactatattagttgatttctataatagccatgtatgacatataggacagtttatatcaccactttatagataaagaaacagagactcaaagagagtgcataatttaactttgtagctgggtgaaaaatggaaatttcagctcagaccttgaagtgacacatatcagaaatcaaaatgagttggaggtagatcacccaatagatcatgagaaaagcagatagataagaaccagttagtaaactattaaacttttctatcctatcaggggaagaacaggtaacttttgaagagatgatttatagaggattttttgggaaacagcattattgtgagcctcacctcctccttcctggaggtgagtgcctgctctcttggcaagtgtagagagaagggttctctcaggactactcatggagcttcacttgtggtccctggccagtgatctggtgtccaggtttacaccagggaaatgtatggaatgagatgggctggccagctgctctggtgagagcaaagcagaagtatctgtgtaggcattcgcttatatgcccagagcattctccaaggcccaggtaggatgacaaaccagagaaaacaagcatgtggttaaaatacagaagagctactaaaaacaaggactctaagccagactgtatgagctccaatcctggctcctccacataccagctgtgagatcttgggcaagttctttaagctttcctagcctcggtttctgtatctgtaaaatctgtaaaattcagataataattgtactgttgtacaaagggtgttgtgaggattaaatgagtaaatataggtaaatcattcattacattgtaaggcctatgcatatgttggttagttatcaaaatcatcctaaattccgtggaataaggatgcctggaggggtgaacagatctcattagagagaagccagagaaattattggattcatagaatgagtgaatgaacacatgggaacatgcatgcatccaaacacattaaagaaacctcagaagagagatgggtaggaacagggactggtttctaaggagaccaggaaaatgctcccagacaaagatctttaatgtctaccgggatcactgaagttgaagtcaggttatgaaaatgccagtcaacctttcctgctcctcatacctttctctgccaggctccatctacacggaagccccagaggggttacaaacagtagctaaaaagtaggggaggaggtaagtgacaaagagaaagcaagcaagtttcacctgccttcctcagctcccaagacagctacaactccagttaggggagcagaagggaggcccacctttgagtggagactgaaaggttggcaaatatatggcattgaacatctctgaattgagactgtattttgtacattcagtaaatgctggactttgtattacctaatgctgatcagaaaagtcacaggactgccaagttttcatccaggggcagaggaaaaactaatgccataatactactcaacaagtataaagggtgataggaaataagagtaaagatgctttgtgactgcatcacatgggccattcctggacagcatactgggttacaactttctcatactatttttgtaatacttactattttattacatttatacaactttttttcactctagccagggcttttaaataaatcatcacaaccaatccagataaaaattacttagcatggaagtggcagaatttgacttgagtctacatctcccaactcaggaaccattctccctaccatgagacaatcgatatatacaatttatgagtctaaataatgcatttttccctttagttcacacttggattgaccattaataagtcttttttcccccaacgggttaagtacttttgctatatattcccattttattgtagacttccactcttgtaacacttttcataggtgcaatgatgtgtgattgctaccaattgaaaatgacttccacacaggcaaaggccatatttgtataacttatgactctccagcgaccagcatagtgcctggcatatagcaggaactcactatatgtctgataaatgaatgaataaatggattaatcatcattttcaccatcagtttcaaagcactgatctttttgagttcagtgattttttgattgataaacaattggtttcatgcataaagatctgtcttgaaatatattttcaattaaaacattacatccactgggttttaatatcagttttagaagcatccacttttagaggtatgtgaaaccttcaaaatcatgattttcatatggggaaactgagtcccagaaattgagaacaacattgagacaaggtcaggatgagaatgcaggcagaaatctgcccctaagttcagcactctttctgtgacttccaactggctgaagaaccctttggccctgtatagctgattgtttttatggattcatactccagggtatcacctggtgagactgtcattgggtgtaaatgaaaagtgaacagaagcctggaggaagcttccactctggcataaataaaggagagcagaatcctagcctaatgttgtatgaagtttggggaaagatcaatagctattaaatcaaaacagcctcctggtctccttaaacccctgccccccaatcccctccaggtagccagcaggctctgaagtgtgttattcatgggtagatttgaggttgtgaatgaagcatccttatgaaacatgggcctgagctgaagcagcgaaggttcctcagggcataaagatagggatctctgacttctccatgggatgtcaggctttggtgaaattttcctggcacatgcctgacccctgctgctgtgaactttgctgggagcctacccatccctcactgggcatctgattctcagcaggtgttcaggaggacaaatggtgatagccaagttgaatgaatgccctctccatgtgggcactgtactaagtgcatggatggatcatctttcacttctcccaataacctgatgagataaataacttcttattatggccattttacagttgaaaaacctgcagctctagaaggctaccacacttcccccaagaagatatggctggtgtagggtagatgaagtatttgaacatacagtctgacttcagagcccacactgacaaccactgagctttgtaactcctacagctcacatggtggcaatatttgtttggggaggtcatggcctctcaacacacctccctgatgctgccctgcctattccatccctctcccgccatttgcatttacactgacgtagagtgtatgagtcttttgacgaacacttacaacatgccttgtatgattttagttcattacagtcagtacttttcttcagtctctgcacagtaggtattgttacatctgccttacagaagagcaaatggaggctcaagaaggtgaaatatcttcctgaaggtcatctgggcagcaaggggcaaggcttagattctgagttcaagggctgggctcctttcaaagtgcttgagtggagccctgcctgactgacccagattgaagtgattcccatacctctaaactgcggctcctcttttcctgatactgtcttcatggaatgcagaactgcgcagcacggaagtccaacagttaactcatgataatggatagttacttgtgtcatgagactttggggtcctgagagtgagggccacctgtgttcactctgcattccacacaaacccttagcccagcacccagcacactatagatatttaaaattccagtggcaaaatgtcatcctctttctccataatttcagctgtgagttacggagcaagtcacttcatgcttcttaaactctactgtccatgtctatcaaaatgaaataataccacctccctataaaattggttgtatggtgaaatgaggaactaaatgtaaaacatctattattaaatagaatgccttatgcaaagtaagtgtctagtaaaataaaacaaatacattaaaaagccgttatcataggaacatctgcacctgaagcaacccattgattatctgaggtttccaaacctgtgaaacataatcatggagtaaaaagtatctctggaaagaaatagaaaacaaataatcctgcttattagtaattatataagacaggtcttaacttagttaactggttttatggtacacagacattgaggcttatcaataaaattaataataatgatgctgatgataataccaagcatctgcataacattgtataattctagaatgttctcatttatagtaacagtggaagggaaaaagagacacaaaaaacaaatatgcaggtatggagtctgaagggtcaggtcacaaaggagagcccagcaaatcctccggtatggctcccctgtctctctcctcttcagtctcatcctttctaactcatcctttccgttgtagtcaatttgatctgccaaaaattcaaatagaatcttataatttatctgtctaaagactcttcatgactttccactgcttttagaacaaagtcaaatgcttgcacatggcttgcaaggaaggccctttacagcctggtctataacagcctcttcatcacttgctgctatctattcctttgtgaagcaaaacaagccaaacctaacgtctcacagctccttcacatataattttctctttcacttcaaatacttcctattcctcatctcccctagctaagagctacacatccttcagatctctgattagctctctgctactcagataaatctttcctgaccctctgcagtaagtggatccctttgttaaatggcagcatctaattattccctcataacatactcttattattcagtatcttcttccccatagactgcaaactcccctaggatcaaataagatattccatatttaagaacctggcatgacaccaggaatgcaacatgatgtttgacttctttcctctcttagactcagtttcctcaaagggataattatgttgacaacatccattcttcctgccatactgggctggtatgaaaataaaaggacatataaaagagtaatgttaaaattcccaattgctattcatttagcagtgatatttatcttattttgtaatttagaaagatgatctacaaaagcaaaaccaaagtaaaccaaaagataattcgaaattttgataggtaagattaggaaaaataccatcaatgggatctgaaaaaaacctcaaaatacttcgagcgaaacacacgatctatattgatttgtctataatgctctatctctgtcatctgtcatcagtttatctatctatctacctatcatccaatgttgatcacaccaaaaccttttttttcaaaacatttccttaattgctaaatttttgtgacttcaaagaaaagtgaaatccatataattctgagtcatctacagttaaatcattaaaacattactttttagtggtcaggagattttgagatgatttgaatacatttcctaaaaccattatcttcttctctcttcattttaaccacccttcctaaacacaatgccacactaaggaaatgagcaaaatcagaatacaacaaacgctcaaaatactgtgggtgcatgaactcataaaacatgaaataactttctgggagttggaaatattggctgaaaacatcattttctcttttgaacctgaatgtgatggacaaaaccaactgaatcagggaaaaaaaatatctatttagtacattatcaagcatctatgataaaccaggctctgaacaaggaagacattgactctaatctcaagaacttatgttacagaagtagagagagacatcaagtaatttcatgaatgccatgcactgcactggactctctgtgaacatgttacaggtaaatctgatgttatctgggatgtcagcaaacgttttcctgagtaaagaatatccaaggtaacatatggcttgacttttagcctaagagcaatgttttatagccatggaggtgataagaactgatctaaattttagagaggttatcaaggtggctttgaagagaaagaaacccagggcagtgggcagtatgatggggtagagaccatttacagaggccactaaccaagtcagcttctttgagactcagtttttttcacctctaaaatggaggttacaatccttctttctccattgcagagttgcctggaggagataagaggatagtgggaggaactaagaagctggtgggaggagctaaaacaataggagggagagctctaaggatgatggatgagctaagagaatgatgagaggaactacgaagatatgggaagaaccaagaaaattatgagtgtgtgaatgcttcacaacctgaaaatgctgtgcatgttaaattaatgggaataaaatgtactttatcagtgtcttcacttccacaaggacatggatcctgtgatgacctacggtcacacacctttgatgaagtatgagagtttttaacttacatttggaggtgagggttctgtaccctgagatcctaatgaaagccagagcgttgatgaagtatgggagtttttaacttatatttggaggtgagagttctgtacccttgagatcctaatgaaaaccagagcctttatttttttagaaaactgcttagtgtagaacaatgcctataatcctcaccgatttccagacacatatgccctgtaatcaatccagggacctcatgttagaaatttcaggtttagtataaagccttcagtcattacagcagttcttttctaacttgtcagattataactcatagtaaaaaatacgcatttaatatttctagccaactgaacaaaagttgcatgaagcagtaatatttcctattctctcctgctatattgttctctatttaatgttattgcagtttgtttttttcatgattttaaatgctggctaagacttataaattgaacctaacttgtagtgcgaaaaacaatgtttaaagaatgacaagcctatttttcagttttgcctctatctgttaattgcaggggcaatcttggacaatacacatctcctctgagcctcaatatcctcagctgtaacatggggataatagcgcttacctgaaaaactgagacaattaaggtaatactataagaaatcactacgcagaaatcatggcacagactaggtgttcaataaactgtagtgattataaatagaggttgctaatgggggaattagagcatagctaaatctctcttgcctgagggaaaataaaaaggaagaagaaaaagaaaaaaaaaaaatctcattcattttccacccagggggtctttctgtcttccaaatgtagctatttgctgtggggagaggaactcagtccaaatgcctctgtttgctgtgacaggatttataaataagtaaaacgctttatcaaacatttatagttgtgtgtgaatccgaaaagaaaaaagaaaggaagaggcacgtgggcttggggtttatttatagtgactctctgcttttccctttcctgccacaattgcacagcttagctttcatttgcttatgattgttcttggataaacttcacttccaaacagagggtattaattattaaaacacagaccagataaaacagcccattctgttcccccaaacaatgacaggatgatgcggcagaaggaagccactagaaaaaagggcagagaattgccaacacacgctttcaaacagagtcaatctttggcaaaactcatgttaacgaacattctgtgggcgcctactatgtgcagcttggaggctacgtcagacatggtggggtggggcagggggctggtgtggggagggaaggtttccatgatgaattagagacagcttttaatttatatcccagtgaagggagggagttcccaacaaaagcaaggaggagatatgtaaacaccaaactctaagagaaagtgcctctgaacaaagtgctttgggaacggcataacagagtacttcctcttaggaggcatcctggtcttggaaggagagcagctctgggatctggctatcttgggtttgaatccctgttccagcacatcctacctctgtgatcatgagcatggtcatctcttcatgacacaggtgtggttatacctcttggggaaggtcattgtgaggactaaatatgaaaattcatgtgaactgctagacacactgcatataatcattaaatagcaagtatttaatagtaataagattcagtttggcacatagtaggcactaaataaatctcatacttcctttcctttgcttgagagtcttaattcaatttcaattgcatccaccttccagccactccaaatacaatgtgcttgtatatcattgacatcctctgtttcccattgtgtgtctcatccttatatgacctcagttgcaatcttcttcagaacttatctattaattaatgtattcatccattaatattgattgagcacctgctaggtgacaacactgatgaaggcactagggattcaatgaagaaggaagacaaaatttctacctgcatgaagcatgctttctaatggggcagagagcaataactgcatcaataagtaaaatataagctttgtcagatgatgctaaacactaaagagaaagatcaggcaggaaaaagaagcatgaattgctggagtgagtgctatttaaaatgagaaggcctggggagaccttatggggaaagtaacatgtatgcagagactgaagaggtcacaagcagccaggtaggtatttaagagaagagtgttccaacagagaagacagcagatgaaacaccttgaggcagaagcaggcttggccgtatcccatttctcattttagtcttcagaaaagaggcagggagcagagtgatttgattttgcaaaacaactctgcttttcccacatactaatataagcaagccataccttgccaggtatcgtatccattgtccacattaggttccacaaatacatgtaccaagagacagatgcctagatgtgttctgccccttctttatgtgacagggcagcatggttctaggctgggctcaaagttgctgggaaccgcatcattaccaccaaccatgccatcctgagatcctgagctctccaaggatgagagctctcagcgacatcccatagaatttggactaacttctcaggatgctagcactttgcaggaggaatttaaataaaactagaaacaaacaaaggcaaaagaaaaaaagaaaagaaaagaaaaaatattacgaggaagcacagaatagaaatattctcctttgcccaactaactgaaacatttgcaggtatgcaatgcctcacagagtacaggtacagggttagtgtcatgtccaaagagtaaaggctccagagaaagccctgcctgcatgggttcctggcctagctgtgtgactgcagaagggttgtttaacctctctgtggatgaatctataaaatgaaactaataacagtacttttctcaaagcactggtgttaatgtaaaatgagttatttgagtaaatgtctaacctagtacctggtatggagtaatctatttgatatggtttggctgtgtccccacccaaatctcatattgaatcataatccccatgtgtcaatggagggacctggtgggaagtgactggatcatgggatcggtttcccccatgctgttctcgtgatagtgagtgagatctcatgagatctgatggttttacaaggggctcttccccctttgctccttcttctctctcctactgccttgtgaagaaggtgcttgctccttcttcaccttcggccataattgtaagtttaagtttcctgaggcctccccagccatgtggaactgtgactcaattaaacctctttcctttataaattaccgagccttgggcactttttatagcagtgtgaaaatgaactaatacactatctaaacattagtgtttaaaagaatgactatatacattttagtaaattcatataaggggacactatatcgtaattaaaaaaaattatcaatacttgcaacaacatggatgaatctcaaacatgatgttttgagtgaaaagaaggcagacacaaaataacgcatctgtaggatcgcatatctatgaagcacaggaaatatcaatttatgatctaagaagccagagtactgtttactttttatgggtggacatggtctaggaaggtacaaaaaaatgaaacataaggggtgctagaattattctatcataaggctgcccagcagaactttctgttacaatgacattgttcatattctatgttgtgtgatacagtaggtactgtagaataggcatatgctgccaccgggtccttagaatgtggcttgtttgaccaaagaactggacttttaagtttaattaattttcattaattttaatttcaaaggccactgtatcgggaggcacagatctatatgttggtctgggtggtggttacttgagtataggcatacataaagaaaaccaagaatacatttaagtctagtgcaatttatatgcactgcatatactttattgagtgttaccttttaaaaattagctatgactattaatctacatgcatcacctcatacattcctcacacacttgaggtaatatagagaggaaagtccccattgtccccatttgtgaactggttcagctgtggctcagagaggtggatgtgatctgggaatggtcacgtggcttgtgaatcccagagtgggtaacatttctatccaagttttctctcacgaatgggaaaaaggcagtgtaaaataacctgctgagatgatttcattcaacaattcattcatcaagggcatactgtttgagtgccagatgctgttttagatgcttaaaagaaaacactggacaaaagggaaagttctggtttccatggagctttcattaggaatctttgctcatcccacactttggccaccccttgggtcccttacctgaagtaacttgaccatgggccaaattgtgtgaaatcagactcaactaagcattcgcagttacctatgctctagatttgactcctgcttcctactggaactacctaggcttcttgttcttctagacttagattttctcatttataaaataaggaaagggataaaagaagacatacaggaaaaatactaactagcataaaggcaaacagcatgtatggcaataaagattcttattacttaattgtaaaacaccaattacttacaaaaaaataaataaaaccacagcaatccaaaacttcattcacttagcaatctggccccaaaacaagaaagcaaaacctgttagaaacaaatgaaattcaccaatcttgagtttgaatgaaagatttttgcacatctgtcttaaaagcaaccgtaactacaaaaaaatcaagcaggcaaaaaattagatatagaaatttggtcaataaaagtaacaggtagtatctaatggttacacatgaaatgttttgtccattaattagaaaatgtacagtgtttctcaaacacacagaaactatttataaaaagtagccatgctccagggtacaaagtaaacctaacaaatagccaagaatttaatagtacccagaacatattatttaataaaatacagtaaaattagtgttaataacaaaaagttttctaaacatatgcctggaaatgtaaataaaaatgtccaaataataaacaaaataataaaaaaatagaattaaacaacatgcacgctacatagcaaaacttgaggtctagagataaagaaacacttcagagaaagttataccatttgatgcaaatattgttaaaaagaaagattgaaaaataatcatctaggcatttaagaagttaaaaaagaatggcaataataataaagaatgtagaataaagaaaatatgataaaaattaatgatatagaagagaaataatatagaatatcaacaaatcatgagcaaagtttttttaaaccttttatcactacgtcttgctctctctcctttactcttactaaaaaacagaaaccaaaaccaagaacaaaaaaaacactaataaaatagatataatataacaccaacaagattgacagacaaggcataaaaacaaaatctctggaattaaaatgaggacagaattatagatgtggtagagacttgggatatgtatagctagctagctaactagatagatagatagatagatagatagatagatagatagatagatagattagatagacacacaaccatgaatacacatacttatttatcacaggtatacaaacacacatgcatatataatactatctgctaaatatttaacaaataatattaaacaacacaagacaatatgtctataaatgagacaacttagaaaaaataagtgagtctcaggaaaataacaaatactaaaacagagttaagaagaaacagacaactaaaatagccatataaatatttgaaccaatagtcagaaattaccatctaacaaatagacaaacatcaaacaaatagacttaagcataaattctagcaaactttatgagatatacccacttcacataataattacatatacaaatatttatacacaatagcatgacagcacaagaaggaaggctgtgtaaacctcatgttttatgaagctaggataatgttgatattggaacttaacaaagatgttaaaaaacgtaaggatagtttactaatagaaacgacagtaatacactacacaatcaggttaaaagagaagacatcacctcacttgatgctgaaagagtatttaataaattgtaatatccaatcacggcttgaaaaatgattagtatattaggaatagaaggaaaatttgctgtcaaaagtttactaacatttactatttggttatctaacaaaaacctaacactctatcattatgatatattatgacatatagtgatagagctttagttttattttctttaaagtaaagtacaagaaaatggcatgctctgccatcatttttcttcaacactgaatgggaggcccagtctggaagagcattagaacaagataattcaaatacaagatacaaagattcgcaagactattaatggcaaattatgtcattttttccacatgaaaatttaaaaaaaatctagaggctaaaagtaataaaataatcacatcttctggcttcaatcaaagaaaaactgatgttcttatacacaagaaaggaacaattaataaatgtaatacaagtgaaaagatacaatttgcaacagttgcagaaatagtgatgctggtagaaattagatacaactaaaagtctgtgatatatgtatagataaaatgtttagatgtttaactctattcatagccatacaagaaggctcaaataaagaaatatattatttcatggatgagaagtctaagttttgtgaattttgcaagtgagtctgtaaattgaatgtaatcccaatcccagtgacagcaagccttttcataaataagactttatcttaaaattcacacagaagagtaatgagagaaaaatagctaagacatttacagaagaaaatgaatgagggagtcctgccctttctgataccaagatattacaaaaccataataactaaaagtagcatggtactagaacaggagagctcagaaactgacctccagatacacgaggacttgtcctatgacagtggtgtcataaatccatggagtaagaatggactccagatagtgaactaggacaattagctatccatgtgaaaaactaaagcaaacaaagtccatggttaaagactgaaatgtttacaagcaaaatcttaaaaatttagaagaaattataggtgcataactaagacactaggatagtaaaaaattctaaattcctcagttattcacaaaaagtataaactacaaatgaaaaaaacattgtagaattaaaatgaaaatattcaaaattaggaaatgattttcttaacaaaactaaaacataagtcatagattggaagaagatattttcacatgacaaaggcctacttatgtttttaaatatgattattatcaatatttataaggaacatttactaatcaggtaaaaaaaaaaccatcataaaaatatgcaaaagatataatcaggattgaaaaagaaagaaaatttaatataaggaaaaatgtttaacctcattattatctttgacatgcaaattaaataatcattgaagttataatttcatatcttacagaatggcaaaatataataagggttgtcgagaatttgggaaaatgagagattttattcattgctggtggagtgtggtaagataaaaaatttaaaagcacaggacacaggacaatcttagataagattatgataccatatataaagtaaaagtataactatccaaataggttagaaatatcaacctttgtgtagtaagaaacagaatcagtgaagttgattagctatgtgtaatttaacattttaaatgtaaaaaaatccgatgtataccacaaaatatttgtattctcatttgggtggttagaatatatgtaattatatttactttattgcatgataaaagtaatttgtaactaaaaataaagtacattttaggagtattttagaaaagatttaattgaagaaaaaaaaagatagatatgaggatgtaaagatgaagccaagggaaagatcagcgctaaaatttaacttacagtgccaggtacagtggcttacacctctaaaccccacaacttgggaggctgaggtgggaggcttgctcaaggccaggagttcaagaccagcctaagtagcatagcaagacttcatctccaaaaaattgttttaattagctaggcatgatggtgtactcctgtagtcccagctacttgagagactgaggtaggagattgcttgagcctatgagttgcagtgagctatgatcacaccactgcactctagcctgggtgacagaataagaccttgtctctaaaaaataaagaattaatacatacaatgtctggtatatttcctagagtttctgtttcaaattagactctgagcattctagcagacagtacaaacatggaaaacttgttatagtattcagatgtctaaaaagtttaaaataaccatctggccaaagaacagtaatcctgattctggtttttgaggacaatgttcctatttcataacctgtgtgagttattaagtaacagcctcacccagaccctctatgaaattagagtgaactacaatgaggtctaatgataaaaacagtacctgtataggccaaggagtgtctaaacagtttatgctctgtaactaacttaatacttacagctagccttgttttattattatcaccattttatgcataaggaagctgagggacaaatcagttaaataacttgactcagtcctacagctgtgaagtggagaaacctggaacagaatgcattctctccaccgcccggtgttaatgtcatcaaggcaaagtcagcttcacagaaatagtttcatcatctccaagtaagatggtccaggtgtgtctgggaccttagaattgtgtgaccaaagctatagattccctccctcagaaactaaaggtacccaatgttttgcaaatattttcagtgtaaaactcaaacatgggccccacattttaaaaatcctactctagaaaggagtgagcaaattgcatcttctcagtcattgatctatgtatctacctgttcaccatggggcatccttaatttgggaggattgctaatataattaacatagtaggagtgcacaagaactactagttgtgattagagtcatcatttttgttattgttatatgcagcaacctgcgacctgttctctcagcttccatgtgtggcctctaatcctccatgcttcctttagtggtaggtggggccccttcaggaataaatctgaacttgtccatcctgtgcctcatttgttccacactctacaagggcttcacacttagaggagaatcccagctctttaccatcaactccaaggccccgtgtgatcgggccctgtcttaggtctccaatctcaccatctataattctcaccttttcttacccactccatcctattgtcccttgttgttggaatctatctcaaagccttgccttatttcaaatactctcttgttctctgataatctctctgacttagcagtgcttcatccctttcattctttattctctctactccatcttgacccttatctccatccttcatgaatgtttttatgaatgcattcatgtaacaaatgtccatgctctccactagaatgaaagctccacaaggacaagtactggtctattttgagcactgctgtgtccctgctacctgaaaggcacccagcagagaacagacactcaatgagtgtcagtgaacagaaggaaaggagatgggtagggaagtgagttggtttttgtgatgataacttttggatactgttttggacagatctgtgtgcccagttttgaagtagattggtttcaccctcaagcacttaaggaccagagatatatgtccaacaggagaggccagcatagacaaaaatcagcagcaaattccccaacatccctcactaactgctccagggcaggcaatgaaaggacaatggataagcgctcagagggacaaaatcagagggggcaaagttctaggatctctgctggcaggaaaagtgtggaattctggcctgcctatcctggcatagaatcctcaccactcagatccaattagcaagggcacagagaagacgcaggcagggaaatcaaagtgccaagggctggcaaaacatcatctgcaggggagaaggctgggcccagctgggctgcatagagcggcaccagccctaattaagttattagacacacatggctgcagccagggtgttcctgggcccaccaccacagacagtgatggctctgtgggaggctgctgactcaggattccaactgagctccctccagccctctcatagcctgtttttccttctcctttcttcctttattcttttgtaaacatagtagatgaagcggatattccctgagagtagtaacagagataacgtacgtgcacacaatccttaacagtctatatgacacaccattagctcatttcttttatttatgtattcagccaatatgtattgaaggcttactatgtgccaggaaatatcccatgtgctgattacagagtatgtgtgaacagacttagaattccaaccaccagagctttctttctactttgggaaggacaagactatatatgtacacagcatatgtatgtatgcatacatgtatataaatatatataatgatatgctgatatatacatattttcacatatatatgcttatgtggggatatatatgtgtgtgtgtgtatgtatatatatccacatatcttctatatatagtcatcttgagataagtaacccagcttgttgccgtttccatctcccacatggtgaaccagtctccaagaggtaaaatggattacttaggatgacaccatcctaataggagaccccatcatttgtaacactagggaagggattagcaatattcttctggctcctaaaaggaagtctctcttcttcctcttcttggttgcttctccttcttgcacctcttccttgcccccatctcttctcttacctttgataaataaaagtgtaatgtaacgacatgagggcttccctcctatgcttgtttctctcctatgcttgctgtactccaggactgctgggcctaaaggcacaggcagggcctttctgcctgattctgaaagaccccactgcagatctgtcattcagaccccactgcagatctgtcatttcaggctgctgaaagttggtgtttagggacttactttacccccaatcccctggttttgccatttccttacctcagacattaccctccctattcaaggatgtaggatgtaggtgatggatgatgcttctgagatcattggttctcatttgatagatgggaaaactgaggtccatctaagggcatccaattcaaatggcagatctgcagcaaagctttgaataaaatgcagggaggcccatttccagatcagtgctgtatcatctcttggagcatgctagctctgcatctctcttttgattcacagagtagtcttccattcttgatctctctgccttttttctgatctaagtttgtgccaccatgttaaatgatctttctgggaggaagactatctgggcatgacacttctcagttaaaagttttcagtggctccctggggcctcccagataaagtcccaggaccctggtgatctgacccatctcttcctctacagtctgctctttctgttcatgttcctttgttgccagccacttgaaacttctcacagttcctacaatgttctctccctgttgccttgggacctttacacatcccctttcccttgcccctgggttcactgatgagcttatcttcaaattcagctcaaatgtctcctcttgagggaagttctcatccacatcgtcagcacatttgaatgccatttcctctgtgatcctggaatatttgttcatatccatatttcagcacactcacagcaatcatttattgactgcttactatgcaccgagcaccattctaaacaactgatctggagtatctttttttttttttttttggacaggaagtagaatttattggtgagtattaagagggggcagcacagtggaagccctcatgagtgcagggcccgccacttgtccagagggccacgactggggatgtacttgaccccacagccatcagggatgagctgcttctcagccaccatgtcttcaaattcatcaacattgaacttggtgaagccccacttctttgagatgcggatcttctggtggccaggaaacttgaacttggccctgcgcagggcctcaattacatgctccttgttctgcagcttggtgtggatggacatgataacttggccaatgtgaaccctggtcacagtgccctggggctttccaaaggcacctcgcatgcctgtttggagcctgcactggggtagcgcaaggtcagaaacataaacatacatctgaaaggcctgtttccatggtcccttaaagcaacccatacaacaaacaggctgcatacactaccaagaaagctgctgtttgcagccattgcacaatgggcccccatgaggaaaggaacccagttggcttaattggctgcagatgatctggagtatttcaattattcttcacagcaatgtataagctgagaatgctcacataactatttcagagatggggaaactgaagcccagagatgtcaaataacttgccccaggtcaaagagctggtaagtatcagagctaagattgggttctggcaaatgtctcaaatacatttcatactgctgaaattgcctgtttactcaactctcttacacacaaccataaacttgttgaaggtattaatccctctataacctagcacttagcacagtgacttcattctgtacatggagtgtgcactttgtaaatggccaccgagtgaacaatacaagactctcttctattttattttatagcatgctagacaacaggatagcacagtggcaaaaaacacagactctggagtcagacccaggtcccaattgtagctctaccacttcctggtgcttaaagcaggtcctgttttgcctggtctgtttcacagggctaatgatgataccatatggaaaaatcatgtgtattaaataaagaaatccatagcaagtacaaagcatagcacttggatctcaatagacagtagatactcagtgtttgttataatggccgttatcattcactgtgttccttcccttacccctttctttctttcctctctctttcctgctcaccttaagcaagaggcgtcctctcagcaagactcgtttgggattcgcaaaagctgagagggagcatgacttctctggcccactgagcccagtgccctccttccccaccccatgctgccaccttccagctgtgaaatggtgtccctgctcaactgggccccaaagctgtcagggggctgccaatttcacagttcacaaggctgctgttccccccgattaatggggtgccagcagccatgggcagggctctgataccagtcatatgggctctctctcccctgcccacacttcctgaggaaaagagagcaggccagcctcatgcatatttatgtagggagagaaatgattttgtactgcatgccttccaaaaaaaaaaaaataataagatttcacccaagtcccaggcatttccctgagtgaactcagcatgcttcagggaagaaaacgacacagacacagacacacacacacacacacaaacacataccccacagatgcacacatggcataatgaaaaactgaaaacactttatataccactgatctgagcagagtgttctcacaccaaggatgacccaggagacacaggagatattaaaccctagagcatggacagaattattttgaaattaatccagttccaccctatagctctagggaaattagaacagataaggtccaaatgtagccgggcactcaaggcctgccccaccacctcctaatcactgcttttgtctacagcattcctgacctcagactaagctgttctctgttccttgtataagcaatcactttcggtggtatatgccatagtggggcagaagaaaagctttcatcttagggcaatcccagtccttctgttccagttacagaacgtcttaaaagccacttcagcttgcagtgtctcggtgcccccatctctgtgtcctagaataaactgacccaggcttcctcactgtgtttgagccacattggccttctaggccattaagcaagccaagtttttatttcaagagactcttcctcatattgaaacatcacgttgggccccacaaatacagacaattattatttgtcaattaaaaaataaaacagaacttttaaaaagatcactttctctgttcttcagttcatttggttgaacgctacatacccttctaattccagcttaaatcttccttcctcagaaaggccttcttgaacagccaaattgaggtcaagtatcccctttcttctcccagagcatgcagtatgtttccttcctggcagctttgtgttaattaaattagtaattgtgtgataagttggttcaagtctccagtctcaagtctgattttctcattagaggatagcatctctgagggaaagggtcacgccagcactttcactgctctgtcctaatgagtatttggtaaatgaatgaatgaatgaattgctgagtagttgagagaattaaataaagaagcatataaagcacccgatctatctgcagaggacttgctcacaatgcactataataactaacattaattgaccctttttcttgtgataagcactcctttaagcattgtgacatgtattaatcatttagtcttacataaattacatcatttgttcttacaacaactcgggtatccacatccttattgtctccattttagaaacgaggacagtgagaggaaggggagcatttactaatttgcccaaggttatacatagctagtaagtatcagtaaatttcaggagttgacctaggtagcctagtcccagagtccacatttctatccactactctctagaaagatattagttccatcccttcaccttccctctcagatatgttcaggcttagataccttggttgaagactttgtcttccacaaagcctttcctgatttgccagcctcactctattacatctgaaaacctacatccccctttcccacatccatgcatagagagctggggttatgaaatgcagccctgatatcagaatatcctctactgccctccctctggatcttttatgggtggagcaaacctcattttcttgcaatgtgaggacacagtccagaaattgctttctcctctggggtcctacagggagacacccagccctcagaaccaagccaatttaacactcaggagaaccctctcctcctggaatatccatctgacctcctttctgagatagctacaggttaagagccagaagaaggtgtagagacctcacaatccatctgcccacatataaacaggctgaggcccagggttgagaaggacaactcaggcaacagacacgctgaaggcacagcccaggctctctcatttctacctgactgcccaccctctgtagcatactgcctcctctcccctggagcagagccgggggtatagcaagcagacactgccaaggacatagctggagctgtgccgagccaaagcaggcagactgtctgtccatggggcgaggctgcttcctggggtgatgaacagcgccaatcaggcagcacttaacgcaattataatgaagtagatgcatctgttctccgaaggcttcattcaccagggaaatcatgaggaagtgatatctctgtctgccgacctccttgggacactctcagggacagtcctggagccaggaagctgttgacatggactggagactggcctcagccatctcagaatgacagtgactgacaccctttatctcttttgcatcatttctgtaaaaggagctgtcagtagataagagttcgcatgagagaatgtcttcctcttttcctggtttttctaataacctcaccccctacatacactgttggtcatgcctgcaagtcatatggcactgagttccaactcagcttccactgattttaatgtatatccacaccccacagttccactgaagaatgcaggtttagaccagcaaggaagggtccaagctgttcatgatacagatgggaagactgagactcagggaggagatatgactttcccaagattattactatttgtgtcaggtggcctctacaccagattgttcatatattattgcatttcatcctgaaaataacctgagaagagtccaacactattaaaagccagcttcacaggtaaggaatccgagactaaaagaggttagttactctgtccacgattgaggcactgtatgggcacacgattcatacccacatctgcccattccacacccatcttgctactatccatcatcccagaaagccctgacgttatagattggctttggtttatagactagtgtgtctataaacattttgataagctaaaagttgtttaaatcctcttcttttttacatttattcctagtgctatatatgaaaagaatcctgtggtgaattgcttttgtaaaatgaagaatcatttaggaaaataatctgtcacttcctgatttatttctttgctaagctgagcttttcacaaatcagtctcctttgaagcaaggcacaccagccctgctctgggcagatggactccctactattctggacaggatatgatgtttgaggatctgccacattcacagatgcgtgctttagtaaaaaggagctgcagatgcttcataacctagagtgtggcttgctaggtaccccaagactccaccatcctgataaagctgataggaacagagctctatatctgcacagagtcagatagttccagattagcttatggatggtgacgtctcctggtgtggggatctcctcactagggcattcagtattggatatgacaaattctttcatggagtgcttgaaaagaaggcatgagagaagagtcagaggcaggcagagcatgtctcacaaggaatggagatgggctaggcacagaagctgtgaagcagtagaagccatgggcatgcagaggttaggaagcatagagaggttatttccaggtgggagccaaagaggaacagagaaaaagaggccaagattcatgaatttagcagagctacttgaggcagaatcaatgagccaattgctgttatatccaatcaatagtgtatctccatgaagcctgagactgtttctgatcatacctgtccttgtgttcctcaaggaacagaaaggtaaaggaagtacgggaagcagagttattggtgaaaagagagaatttcaaggtcacacagacctagcttcaaatcctgggtctaatacaaaccaggtacatgaccctgagctagttaccagagcctcctctgcttcggtctcctcatctgaaaaagggagtgattagaagtaatgaccatatcaattttttgaaaattttatgcgtaattatttattaagtactggtcacacaacttggcccatatagagtaactaatattactcctatttctactaaaaataaatcctggccgggcgcggtggcccacgcctgtaatcccagcactttgggaggctgaggcgggcagatcacgaggtcaggagatcgagaccaccctggctaacacggtgaaaacccgtctctactaaaaaatacaaaaaattagccgggtgtggtggcgggcgcctgtagtcccagctactcgggaggctgaagcaggagaatggtgcgggcctgggaggcagagcttgctgtgagccgaaatcacgccactgcactccagcctgggcaacagagcgagactctgtctcaaaaaaataaataaataaaataaaataaaataaataaataaaataaatcccattagctgaactaaatagccaatcatttgaaatagaaagaaactgaattaaggcatttaggtaagtcttccattgattcatttactcacttgttttatcaattcactcctcaattatttatttgctttctatacagtgccaggcaatgttctaaacaagaagcagacagcatgggacaaaacagacacaattcttaaagatggacagataatacttataatgggtcaaatggtggcaaaaattataaagaaggccgggcgaagtggctcacgcctgtaatcctagcactttgggaggccaaggagggcagatcatgaagtcaggagtttgagactggcctggccaacatggtgaaaccccatctctactaaaaacacaaaaattagcagggcgtgttggtgcacgcctgtaatcccagctactcaggaggctgaggcaggagaaactcttggacctgcaaggcagaggtcacagtgagctgagattgtgccactgcactccagcctgggagacagagtgagactccatctcagaaaaagaaagaaaaaaatagaaaaattaaggtaatggagaacacagtgtggtgcatgtgtgtatgattatgtacattgttttattttttattttatacaggctggtcagggagggccttagggtgctatatgaagaaaaacctgaaggaactgggggaacaagccatgcaaagccctgaggaaagaactgttcaggaagagagaacagagatgcaaaggccctgagattgatgaagatgatgatgatgatgctaaaaaataatgatgtgctatggtttgaatgattgtctcctctgaaactcatgttgaaagtcaacccccaatgtaatagtattgagagatggggcctttgagaagtgattggatcatgaagattctgacctcattaataggttaatccactcatgcattaaaggactaatagattaatgggttgtcatgagaataggttagttatcacaagagtgaatctgttttaaaaactaggttggctgtctgtcacgagtctccctggtcatgtgatgccctgcgctgcctcaggactctgcagacagtccccatcagcaagaaggccctcaccagatgcagccctcctaccttggacttcccagtctgcagaactggaagaaataaatttattttctccataaactacctagtctcagatattcagttaaacagaaaacagactaagacacaatggaacaataacattgctatcctacatctgtgtagtatgttacagttacaaaaagcattcacctttataattgtttgttcctcccacgttcttgtgaaactggaatctccattttaccaatgtgacaaccaaggcttggagcagggtttctcagccttgatttgatagatattttgaggtgggtaattatttgctggggttggggggcggtcctgtgcattgtagaatgttaagcagcatccctggcctaacccctccctagtcatgacaaaaaaaaatgtcttcagacattgctaaaggtctccagtgaaagatgtgtgtgtgtgtctgtgtgatagagagagagagagagagagagagagacagagagagagagagagaggaaatcacccccgatcctggttgaaagtgactagttcaagacatcaatatgtcgaaattagtgagtaggtaaggagataagattagaatctgacccatatcccctagtcaggaaagtttaagaccatcaccctttccatagcatgaggagttttccgaagttgcctgcgtatattaatactggaaggtgtcatgtagtttatgggggtggggtggaggagagtgagatgaggagacatagtggggctatcatctccattttccagtcactggcctctacttcagtatggaatagcagctaagggagcaagatgcctgtctcctcactgctgtgttgttgctggatgccgaggaaacatcgtagctgggaactcttcagaaaccaagctcctgtcctgccaaagatgttaaccacccaggatggcttctagccaagttacaggggttcagcattcattccacggatgagaaagcatgcatagatgagaataaacaacttgtttaaggtactacagtttttaaatgtggagaagaaagggcactcaataaatgtctgacttggaaatgccaaggaataatgattctatgggctactgactgtaaaagcatccacattttgagagtcccatgggagccaggtacccgtgggaattatctatttgcaggcaggtcggtggcctctctaaccatgctcagtgggcagcactacatctacctgagcatcagtgagtgccctttccccagagcgtggagtctgagaatggccgtccattctcaccaggacttcataattctagtgtcccctcctgtccccacctgggacagtgggtagaaggtcctgtctgccagacatcctaacctcccagataggagactcctacatcctgaacaatgtcttataaaaggacacaaaaaaggtgaggattgtaagctgtagagaaagaaaacaacggcacttaaaagtgctcaggagataggatcaggagaactgctgtttacccactacccactaggcagcaaattagtcccttccagtcagggatatattcatttgcccattcacccattcattttaaacatatttagcaatctcctatgatgagtcaagacaaaggcatgggctggaacatggatagaaaggaactccttcagaagtggtgtggttgaaacgttaagatggcattgactagaaacagaatgtccacatcaaagccaccattccccacaaacgctgcatcccccatacacccagtattaacttgctgtgtaacttcagatacctctctcccctccctgggtctctgttgaatgaaatgaatatttcagacaacatgtcaataatagcttccatttcttgagtcaaaacactgtgctattttatatatatgatttccttaattcttacaagaatactgcaaaacaagtaatcccattttagaggtgaggaggttgaatctcaaaagtattagtaaggtgaaactggaccccggtgtgtctggttcaagagttgggcatcttaactactttatcctctgctgtcaaagttcttaaaggtctcttggtctctgatctgctgccagcctctgcctggctggtaaaacaaaactcaaggagttgaaagagagtggtatcctttcctagactaatctgtgcatccctacccttatactaatggagagtgaagatacataccttctagaaagtcttaaagatcctaaggcctcccgctcttgctacacaaaataggaagtgaatccattgttcctgtatactctgggttcccactgctcagatcataagggctgtctcaatttctccttcctctgggagatgtgagttccaatctctcaggaaggagggagaatttaggttaaggaacttaatcaggtggtgttcctgatgaagtagagagagcagcccttccaaagcagttgctaccactcagctcctgctaagtgctggaaggcacaagaatgggcctaaggttttgagatccttcagtcaccaagtgaggcagaaatgtgaatttctatgtgaaattttccaatttatatatattaacaactgaattcaaaaatataccctgtaggcaagcaaaaacaaaacaaaacaaaacattatgtaggggctaaattctgcctgtgagtttccatagtacaatctctattctctgctctcgttagtatcctcgcttctgagttgcaactctatgtccaaatcactccttctcagtttggccctaactgtttaccacctttgcaaaaattcattcccccattttccaatggcttttcatgtcactcacaggaagagtcagtgtccctttctatcaggctctacatgactttcttaccactgctcctataacccaatttattctagtgctctctctctcaatgctactcctccctattcctctagtgctccaatcacactggtgccagggacctttatacctgctgttccctctgcccaaaaagctgtttcctcaaatattcaaatggcttgcctcttcatctcctgtagatcagttttcatgtgttatctgatcattaagacctttcctgagggccctaattccctcctttgttttctttctcccccattgcaattattatcattcattattatatatctaatatatacatatattttgttcatttgcttatagtctttctgtgctagaaagaaactgctatagaaattgacttgcatatatcttatttattgctttatcttcagtgccttaaatagttcctgacacacagtaggtacttaattaaagcttgttgaattaatgaatgaaaaatagatgaataaatgttaccttatttaacaaatgtgtatggagacttcccaacagatattgagctaaacatgtatcaagaactttaaaacattcagaccatttgacccaataattccactcctgggaatataccctgaggaaataacacagaatagtgaaaatgaatttaagactaaaaatggttgttgatgttgaatacaaaatagcaaaaaaaaaaaaaaaaaagctgctaaaatgtccatcaataaatacattatgaagcagtcatgagatagaattacatgcatgttgaaatacttattgtataatattaaataaaaatgcaagatagaaaacaataatttttcactttcaatatataaaagggaaaagacagaaaaaattagtaaaaagttactgtggctattcaatggggcatacaaaaaattgctaatttatactttactttcaagtgttcactaatgagcatgcataacttttataattaagaaatattagataaaataaggactgatcatacttgtggtagtagtgatgaatttagctctacagtggataaagatatcaaatccagaggcaggctggttctttgtcagaggcattgaggttgagctgtcctggactttctttgtcagtcagttccccactgggtgagctccagccatttcaagggagcccaggacaggaggtacaaagtcccctgactgctgggaaactgcttcagctctgatcaatcagagaacagtcgcttcagcccctgacatttaccaaacctccttcaacctcatctgtcactatgcggtggtactgccttgccagccacagtctaatcaagtcagaatgtgcaagggtccccagagataaagagaaagcggggctctgagggagtagggagaaaggagagacagggagatggaaaaggatcatgagggaggaggggaagagcaaatgttcagagcatgcccgtttgttttgctatcatggcaattaatgctgggaagtgacattttaaggggctctagtgacagctttggtgacattcctgtttgtgattccatgacaaatctctgtctatatcttattttagagagtgtgtagagacagctcagaggatggctatcaggggatgccaagctcctgtctgttggaggcattgctgctgcctgctttgcagagcctaggcatttagacaccagggccaaacgtccaagaggaggcaccagctaagaaaccaaagcaaaaaagccgcagaggcagggtctggtccaggatggccttgtgaactccaccatgtggtacaattaattggagcaaaaaatgaatgctctgccattctacaagtgacatttggtttgtcaatcagtggcaaagaaaaaaaagaaaactcaattctgaatactttccaggctggctagttctaaggagcctattttcaaacacagatattgcctccttgttttctaagaagtcctaagatgaaaattaaatagaaataaattaagctcaaattttacaagctgagaattagaagagattacttaaattgtgtctgatctctccccatgctataccattttgacaaatgtctacctagtcttgtttgaatacttccaaagagtagttcatgatctttcagattaagagggggagagcaatgtagatataacaagttgtttaccaaataatattcaggatgtcacagggataaatacagtgtggcaaaacaaagagagtactgaacttgaacttaagggatgtgggtataaagtacaattgcaccatcaaactctctgtatttcatggatgagtgacttaatgtctcagagctggaacaaggttctgtgtctctcaaaagtgttcaataacacacagtttatcatataatgtttatgaagccattctataaatgttaaagtgctgtataaaataaagcagctattaccgttttatacccttcttaactgtgaccttttagggaaagactattccctattttgctatgtatgtctacattaaacagtcttcagcacacagtgggtgatggtaaacatttgttaaagaaatgaatatgaatgaatgaacaaatgaatggtgaggaagaggtgtacccaaagagaagaatcaggaagtaaatgcaatcctgtctccccctgtggctgtggagatggctaatgaaggaacagaggacacaggacagaactatgagccttcaggacatttaaaatgcaaaattcaaacatcactgggaatagggagaggacagaggcaacatggagaggaaagaggcagtttggtataaggatgtcaaggcactttgatgttaagaaagtcatttctggctgggcgtggtggctcatgcctgtaatcccagcactctgggaggctgaggtggttggatcatgaggtgaggagatcgagaccatcctggccaacatggtgaaaccctgtctctactaaaaatacaaaaattagctgggtgtggtggtgcacacctgtaatcccagctactgaggaggctgagggaggagaatcacttgaacttgggaggcagagcttgcagtaagccaagatggtgctactacacactccagcctggtgacacagccagattcagtcaccaaaaaaaaaaaaaaaaagaaaaagaaaagaaaatcatttccaaatttttcttcttttcatcctagagggcctatgtttcaaaaataatcccacatgcaaccactttaaagcagtcttgcttttgttaaaacaattctgcccattctatcttccccttgccctgcacgtgctcctggcagcaccctcaaggcacagtcaaatgggagctgctgttagtaagggagttccccaggctctctgaaaactggcatctggggcctcagaacagagtatggcttaaagatgggcagtaattcccatgcagggagcagagggcagggtgttgttgttgttgttgtttttcctttccccagggaagatagagcatcgtacagaaataagataagatctgaggcacaaggcacaagaaagggcaggttgagcacatttcataagagcaaatgtggaaatgatgggcccagtggcctatagggttgggtaaaagacacaagtggctggccatagaaatggcaggggtaagacctaaaaccctcatgtgggccttgcctggctcaggtaccatttccagttcctccaccaacccctcaaactgaagcccttgaattatcttcatccttcagatctctgggaaagaaatgtctcctgcaagccacctcagatccagttgtcatgcacctgttcccactgtggcctctggcactttattagctcctctaagaaagaggtttttaaacttaaggttatgacccactctcaaactgtgaaatcaattcagtggctccatcagcattacaaaaatgccatcaaaagaatagaagctatcagaacatggtcccatgtaatgacaatgtgtattattttgcaaaacttattttagagatgtgcgcacacacattcacacgtgaatatgtgcaggctcactgtataaaacatagttttgattatgtctgctgttcaacgttgtggataaacatagctctaagagacttagcttgctgacatctaagctaatgtctttcctctcctgctcatataaatggacaggagtaatacatgttgtgttatctccagcacatgcttggacttgggtatcagataaagctgggttcaaattctggttccattatttgtagttgtataaatttgagatgatatctagattttgataaggataatacattctttatgagatagatgcaaagattcaacaaatcattgacttgaaaatgctaaacaagatttgtccagtgcagagaaaagacaaagaacacatagaggttaccaatcagtggaaagactaaaatatccatcagtccattcattcattcattcattcattcactcatttattcctctatccactgacccagcatatttattaacacctgctatgtgccagggattgttttaagcacagaacaaacttggtactgatctcatggaaccttcagcctactaagataattaaaatacttaacaaatccaaataataaaaagtactattacaagaacaaatagtaaagttgacagaagacaaaagagaggaactcacatagagaaaagaggtttgtctgaagaaatgagatttaaactgagatcagaatgatgagagagagccatccatgccctgacagattggggaaggaaagagggtagttttccaggcaaagataatcatggcacatacaaagggcataggagaagaaggttagcaagtctgaagaacagagaagaggccattgtgtctggagcatggagggcaactttaagttgggactgttgtgactggagtgatcacaacagagtggctgcagtgtggagaagggaggaagaggatgggataaaagcaggaagaccaataagtaggtatgtgaggatgaggtaattgtggggatgtcaggaagattgatgtggcttgaagaggaatggacggtcatagggtgggaagcaggggtgaaggcgaggagtctggaaacttaggctagagcctcattgtgaagaagcttgaacaccaagataagacattgaataaggtgttgactctgaaagagctctgaaaattcatgaaatgctacacaaagatgaaatttacatgacattcacagggggtgtcagaagggtgagttaacaaacagcttctctgtttctgacaccctagagtgatctattgacaccaaacatgagttccctgcacccttggggaccactcgaaacactcccaaacaataggatctccctgctgcaaagttccttctgccaatttaggagctcagaattactgtgtaacagcttccttcttcagggaacacatgttgattacctattttttattcccagatttgtgagtgaagcaagcccatggttgctgtgcattagctctccctaagcttttaagagctcattgccgtcccaaggattacgaacctcagtgtggtgtagtgagttcaaatcccagctctgcatcttactacaatagctctcatgttggagttttcacctgactcagccatactccagctgtgttaccttgagcaagttacttaacccctctttgctttggtctcctcctctgtacagtagggataacattagtacacacctcatagggttattgtgaggtataaatgacacaattcatggcaagttcccagaagagtggtagaaatcagctgttgtcagcagcagcagcaacagtatcctagcctaatcaatccttccatccatcttctactcaggattaattacaaatggcttaatgaggtaatgtacaggacagcagctggcttccccacaggcactcaataaaagtcccttgtccctttctaccaacaagcattccattcagatttcttggactgggatcctgagaaatagcaaggttcagtctactggtcccatgtcccagagatcacaatgccttcctatctatcactgtcggccattgctggtatttaagggtatatctctcttctgcctccaccctagattctaaactgaggcaggagagcagagaaaagcttgcatactgcacacttcaccaaaagaatcatttttcatggtaactatgaggactgatattttacaaaggaaggcatttggaccaatgttaactgagggaaaaaaacaaacaaaagagaaaattatgcatataaaatgataacaacgatatagataaagaccagaagcacccactataatataagaacagtcagtttgatggggtagtgggttgtttgtgtagatctgtgtagaaaagcatacccagctccccttgagagaataaaacagactttttaaatggatatgccagcatttatcaaactttcaaatgcatgtgccttctgatgctgtgattctgatttttggtacacatctgtcctacagaaatattctcatgctttacaagaatagctagctaggtatacgtacaaagatgtttgttgacccatcgtaagtgcagaaaattaagataatggtcggatgtgagggcaatctggctgtgacatctgtcaccccattgatcaccagggttgattcagctgatctggctggctagatgggtgtcctcttcctccctcaatgctccatgtgcatccctcctgaagctgcgtgctcggttgaagaggataaccatctctgacagaggatgactggtctttagtcaagggtatatgagtagctgcactaccctaccagaacctctaaacaagctctcaagataatggtcaacaatagagggttgcaaagtttgatatatttggtatgttcttagcatgtgatccagcagtacagacttcagtgggagtaaggtaagtatgcatggctgacttgaaaagatactttctatatacattgcttaataaactatcaaattgctgcagaatgatatatgtggatgagataaccccactgactccattaatatatatgtaggtgcaagtgtgtgtgtgtatacacaattatatacactgatacacacacatccatatacatatgtatgtatgttatggctatattggaaaatgccagaagaatataaattaaataaaacaatatattagcctttgggtcctgtcagtggaatagaatgaacaggcaagggtagaacatttagttgttgctttatataatacaaacttctttttttgtctgaaaggtctttatttcatgttaattattgaaaaatattttgctgggtacagaattatagattggtaatttttttcctataagcactttaatgatgtaattccattgttttctggctttaataattgctaatgaaaaattagttgtaagtctaattttcttctttgaaggtaatgtatctttttcttctggctgtttttaagattttttttctttgtcctttgttttttaactgcctgaataaaatgtgcctatgtagtttttttttcctttatttcttctaaacaaaaggggggtacatacacagaatgtgcaggtttgtcacataggtatacatgtgccttggtggtttgctgtacctattgagtggtcctctaagttccctcccctcacccccaaccctccaacaggccctggtgtgagttagtcctctctctgtgttcatgcattctcaatgttcaactcccacttatgagtgagaacatgtggggtttggttttctcttcctatgtaagtgtgctgagggtgatggcttccagcttcatccatgtccctgcaaaagacatgatctcattcctttttatggctgcatagtattccatggtgtatatgtaccacattttcttttccttttttattatactttaagttctgggatacaagtgcagaatgtgcaggtttgttacataggtatatatgtgccatggtggtttgctgcacccattaccacattttctttatccagtgtatcattgatgggcatttgggttggttccacagccttgctattacaaatagtgctgcaataaacatacatgtgcatgtatctttatagaatgatttatattcctttgggtatatacccagtaatgagattgctgggtcaaatggtatttctggttgtagatccttgaggaattgccatcctgtcttccacaatggttaaactaacttacattcccaccagcagtgtaaaagcattcctatttctccatatctcatcagcaactattgtttcctgactttttaataattgccattctgactggcattagatggtatctcattgtggttttgatttgcatttctctgatgatcagtgatgttgggctgtttttcatatgtttgttggctgcataaatgtcttttgagaagtgtctgttcatatcctttgcccattttttgacagggttgtttttttcttgtaaatatgtttaacttccttgtaaattctggatattatacttttgtcagatgggtagattacaaacattttctcccattctgtaggttgcctgttcattctaatgatagtttcttttgctgtgcagaagctctttagtttaattagataccatttgtcaattttggcttttgttgcaattgcttttggcatcttcgtcatgaagcctttgcccatgcctatatcctgaatggtactgtctaggttttcttctagagtttttatggttttgggttttacatttaagtcttgtttccatcttgatttaatttttgtataaggtgtaaggaaggggtccagtttcacttttctgcatatggctagccagcaccatttactgcagagaagattctttccccattcctttttttgtcagttttgtcaaagatcagatggttgtagatgtgtggtgttatttctgaagtctctgttctgttccattggtctatatgtctgttttggtatcagtaccacgctgttttggttgctgtaggcttggaagtagcatagtttgaagtcaggtattgtaatgtctccagctttgttctttttgcttaggattgtcttggctacatgggttcttctttgactcatgtgaaatttaaagtagttttttttttctaattctgtgaagaatgtcaatggtagttcgatgggaatagcattgaagctataaattacttttggcagtatggccattttcatgatattgattcttcctatctctgaggatgaaatgtttttccatttgtttgtgtcctctcttatttccttgagcagtggtttgtagttctccttaaagaggtccttcacatcccttcttagctgtattcctaggtattttattctctttgcatgggagttttattctttttgaatgggagttcattcatgatttggctttctgcttgcctattcatgtaaaggaatgcttgtgatttttgcacattgactttgtatcctgagactttgctgacattgcttatcagttcaagaagttttggggctgagatgatggagttttcttttttttattattattattttttaaattttattattattatactttaagttttagggtacatgtgcgcaatgtgcaggtttgttacatatgtatacatgtgccatgttggtgtgcttcacccattaactcgtcatttagcattagatataactcctaatgctatccctcccccctccccctacccaacaacagtccccggtgtgtgatgttcgatggggttttctaaatataaaattatgtcatctgcaaacagagacaacttgacttcttctcttcctatctgaataccctttatttctttctcttgcctgattgtcctggccagaacttataatactatgttaaataggagtggtgagagagggcatccttgccttctactggttttcaaagggaatgcttccagcttttcccattcaatatgatattggctgtgggtttgtcataaatacctgttattattttgacatatgttccatcaatatctagtttattgagagtttttaacatgaagggatgttgaattttatcaaaggccttttctgcatctattgagataatcatgtggtttttgtctttagttctgtttatgtaatagattacatttattaattttcatatgttgaaccatccttgcatctcagggatgaagccgacttaatcatggtggataagttttttgacgtgctgctggattcagttcaccagtattttattgaggatttttgcatcgatgttcatcagggatattggcctgaagttttctttctttgttgtgtctcttcccagttttggtatcaggatgatactggcttcataaaatgagttaggaaggagtccctccttttcaattgtttggaatagtttcagaaggaatggtaccagctcctctttgtatttctgatagaattcagctatgaaaccatctggtcctgggctttttttttttttttttttggttggttggttattaattactgcctcaatttcagagcttgttattggtctattctgggattcaacttcttcctggtatagtctttgtagggtgtatgcatccaggaatttattcatttcttctagattttctagtttatttccatagaggtatttatggtattctctgacagtagtttgtatttatatggggtcagtggtgatatcctctttatcattttttattgtgtctatttgattcttctctctgttcttcattagtctagctagcagtctatctattttgttaattttttcaaaaaaccagcctctggattcgttcagtttttggagggtttttcatgtctctatctccttcaattcttctctgattttagtttgctcttggctctctagctcttttaattgtgatgttagggtgtcaatctgagatctttctagctttctgatgtgggcatttagtgctataaatttctctcttaacactgctttagctgtgtcccagagattctggtatgttgtctttttgttctcattggtttcaaagaacttcttgatttctgccttaatttcattatttatccaggagtcattcaggagcaggttgttcaatttccatgaaaatgtgtggttttgagtgagtttcttaatcctgagttctaatttgattgcactgtggtgagagagactgtttgttatgatttcagttcttttgcatttgctgaggagtgttttactttcaataatgtggttgattttagaataagtgtcatgtggcactgagaagaatgtatattctgctgatttggggtacagaattctgtagacgtctactaggtccacttgatccagagctgagttcaagtcctgaatatccttgttaattttctgtctcgttgatctgtctaatactaacagtggggtgttaaattctcccactattattgtgtgggagtctaagtctcatcataggtctctaagaacttgttttatgaatctgggtgctcctgtattgggtgcatatatattcagaatagttagctcttcttgttgaattcttcctgttaccattatgtaatgcccttccttgtcttttttgatctttgttggtttaaagtctgttttgtcagagagtaggattgcaatccctgcctttttttgttttccatttgcttggtaaatcttcctccatccctttattttaagcctgtgtgtgtctttgaacatgagatgggtctcctgaatatagtacactgatgggtcttgactcctcaaccaatttgccagcctgtgtcttttaattggggcatttagtccatttatatttagagttagtatcgttatgtgtgaatttgatcctgtcgtcataatgctatttggttattttgcacagtagttgatgcagtttcttcatattgtcatcggtcttcatattttggtgtatttttgcagtgcctggtacgagtttttcctttcatatttagtgcttctttcaggagctgttgcagggcaggcctggtggtaatgaaatcccacagcatttgcttgtctggaaaagattttctttgtcctttgcttatgaagcttagtttggctagatatgaaattctgggttgaaaattctttaagaatgttgaatattggcccccaatctcttctggcttgtagagtttctgctgagaggcccactgttattctgatgggcttccctttgtaggtgacctggcctttctctctggctgcccttaacagtttttccttcattccaacttggaaaatctgatgattatgtgtcttggggttgatcttctcgtggagcatcttaatcatgttctccgtatttcctgaatttgcatgctagcatgtcttgctaggttggggaagttctcctgaatatatatcctgaggtgtcttttccagcttctttccatttttcctgtctccttctggtactccaatcaattgtaggtttggtctttttatgaagtaccacatttcgtgcaggctttgttaattcttttttgttcttttatctctattcttgtctgcatgtcttatttcagtaaggttgtcatcaaactctgatatcctttcttctgcttggttgatttggctgttgatacttgtgtataattcactaagttcttatgctatgtttttcagctccatcaggtcatttatcttcttctctaaactggttactctagttagcaattcctctaacctcttctcaagattcttagcttctttgcattgtgttagaacatgctcctttagctcatcatggttttttattacccatcttctgaagcctactctgtcaattcatccatttgatcctctgtccagttctaggcccttgatagacagatgtggtgatcatgttgaggagaagaggcgctctgctcttttgggtttttagcattttttcattgattatttctcatcttcatgagtttgtctagttttagtctttgaggctgctgacccttggatggggtttttgtgggggcctttgttgttgttgttgttgttgtggatgatgctgttgttgctttctgcttgtttgtttttctttcaatagtcaggtccttcttccgtagagctgctgcagtttgctgggagttcacttcaggccccattcatctgattcactcctgtgcctggagatgtcactcaaggagtctggagagcagcaaagatggatgcctgttcctacctctgggacctctgaccttgagaggcaccaacctgatgccagtaggttcgctcctgcatagggtatctgacaacccctgttggagggcctcatccagttggatggcatggagagaagggctcatttaatgaagcactttgtgccttggtggagagggtgtgtttttctgaggggaaacccactgttctgggctgcccggattcatcagaactaccagaaggagaggctaagtctgctggtccacagagaatgtggccaccacactccccaggggttcaggtccagggagatctgaattctgtcccagagcctctggctggagttattggagatcctacagggaagccccacccactgaggaaggatgggtcagggttacacctgaacaggcactgtggccgcctactgccattgccggtgtgttgggctgtggggacaagtcttgggaccaagctgtgtagcctccctggctccacaaaaatttttgtgtatttttggatttttagtagagacagggtttttccatttcggccaggctggtctggaactcctggcctcatgtgatccacctgcctcagcctcccaaaggctgagattacaggcatgagccactgtccctggctgccttgatttatcttgattgatcaactgatggatcaatcacttagccaacaggcattttcagagtgcctactatgaagtgttagccactatgctggatgctacaaaaacaaagataaaggacactgtactctctctcaaagatctctaagtctagcttagcagacagaaagagaaactgattatttttgtacagtgtgggaagtggtcagttcaaagtaatcacaaccagctttaagagctggaagagggagtagattactcatttgggttgggttgaggaagataactgatgtagaaactgattaggggctaggaaaactcctccagcatttggagttcatttatcattggatacccacagcaaatctatgacctgggaagactggctgttaaaaaaaaccaaacaaacaacaacaaaaagaaaataaaagcattttccatataaggacagcaatgctcaatgagttatgctgcaaaagccaaaactaaaatatataggaagatgttttctgccttatctaagtgattttcttttagacaaaggaagcatgatgttttggcctgctggtattactgccaaatgaacatccttaccctttcaaggccatatttattgtctgaccttcactgggcactgtctatgtgggaggcactgtgctgggcattgcaggatacagagaaataaaataaatgcagactgtccttgttgtaagatgagaaatcacatgaaaatgataaataacatttgagaaggcaaacaaatgggggtagtgacaataaaccagcagttcaaacacagaagagcctatgatggacaaggggaatattcaaagcattccagagcagtgagcatatcatggtggctagagcttgaaggaaagctggagataaatattacagctggatttgagagaatctcagaagtccagctaaaactgaaggactgaggtctacacatacacatcttggggttcaagacttaccacgtgccaagtcatggggtaggtattttacacatcttttatttttatatctaatcctcccattaacccttcaaggaggaaactgaagccaagagtgttacattcccagtttcccaagatcacactataagtaaatgggacaagatttgaacccaggtccagatgacttcaaaatctatactctcatctacattatcactctactttctccctgagtttctaggattgaaaaaaaaacctactttttaaaaagccccccgactttttctgtttgtccactgagcatcaaggaaagatgggcctcagaggagaatctcaggagtagaaaagaagaatgcagaacccagagctccagggaaggggccaaactaaaaaataaggctttctttaggctctcaaaagtagcggtcggtgtctgaaccgggatctccagcccaaagctttcacccgttatcatcatcagcctcacaaggaatgaagagataaagaagaactgtgcctttgttgcatttgtctaaaggaaaatagctaaattccatctgtaaacaagctcaacgatagacagtaaaggcaaatgtaaacacatcctgtgcttatgtccaaataatcaattgtccccaaacaaaacaaaggaaatgggtctttgcaacaacatatgtgaaaaggagcaagaggtattagtcatcaaaaagtccaatgtgaggggagtgatgtcagcaagatgcatgataagagacacctggcatttatattccaacaagaaaggaccaaagcaatgaataaacagctaggatttgacctgagtgtcgtcgaaggcagagcaccgaaatgcagcagaagagtggagaagcatctgtggtgacaggaagtccatgagggcaatgtagagtcacccagcctctgaagcaccatccccctggcctggattagatttgcctagagtcaggagaaacttctcactgtggggaaaagataagcagaagatctctatccgaccccattgctaccacaaacacctacagtccctactacaggagaattccacagtcctcacaagccctgagcccagtttaaagagccaccaagaatttatacagctgcactgtcctggattagaagcacagcatgtgtacttctcacttccacccaccatgtgagccaagttgctgcagcacggtacacacctcatgagtgtgccctgctttgggggccaatagccatggcacctctccagcaatggggctccatcttcattaccccaagcccacacgggtggctgaatgtcacaagcccagctttacagagcttgggcctaaaactggctgtgactcttgtcctacagagcagagaaaccaacccccactaccctacttccagccagagaaacagtataacggtcccacccacagctatcctgccttgagccagccaaaccactgctcacccaccctcaagtgggagaagcctctgagcctccaagcagctgatataactccagggcagcagaatggctgcatgcctatgcacaggacctgagaactggctccagagtgcccccacccactacagatatatccctggcctgcctaatagttctacgccccctaaaagagcatgagaaactgtcccacaggacagccctggtgggcataccaccagaacagccaagcagccaacagcccatgtcctgaacctgaacagccccatcagccactccttgtggacattccctaggctggccaggcagctgcgcacctacataccaggcatgaaacagccctgcaggctgctcctggtgggcacacacctgagccagccaagcagccttgtacttatattccagacctgagaaacagccccttgggcagatatgcccacaggttggatgagcagctatatggccatgtcccaggtccaaaagagtcctgtgggccaccacccacagaaacgccccaaaccagccaagcaactgtgcagttatatcgtgggcctgacaaacagccctgtacccacccatggtagccatgcccacccaggctgttcaggccactgcatgcccatgtctcaagctggagaaatggccctgtgggttgtccccctcagacacattttcaggccagccaagcagccatacacccacatagcaggcctaagaaactgtttcaaaggcagctcctggcagatacacacctagaccaactgagcaaacttatgcccatgtcccaggcctaagaaacatccctatgagctgcccctggtagaaatatccccaggccagctgaaaagctatactcccacattctgagcctgagaaacatccctttgagcagctcctggcaggtacgcccccaggccagctgagataccacgtgcccttgctcctggccagaggaacagccccatggccctaatatcagggaatcagaccccaagctgcatgaacatccccctgttctgagaaatagcccagtgagcccaatcctggcaaagctgcaccaccatcaccacaaactctctcagcctaggtcactgagtatcttacaaatgtcactaatgtaaaattgtagccaatttaactacatagaaactctagtattgcatctaactaaaatccaggacagcacaacacaccaaactaacacctcaagaccaagttatacaaataagtctttccttatgaaacctactcaataaaatcagaagtaataatttttctaccacatgctaagaaatcaacatagggacacatcaaacatgaaaaatcaaggaaacatgtcactgtaaaaggaaaacaataatttgctagcagcagaccctgatcataataaaatacatgaactgccaaaaaaattaaataataattttaaataaactcagtgaggtataagagaagaaagatagtcaatttaactatatcaagaaaatgattcatgatttacatgatacattcaacaaagagatagataccataaaaaagaaccaaacaggaacaaagagctaaagaattcaatgaagaaagtaaacatatgaatcaagagcttcaacaatagactagggcaagcagaaaaaaaaatctaaacttgaagacagatattttgaaataacacaaggagtcaaaaagaaaagaaaagaaagaataaataatacaaaaaaaagaaagcctcaagtaagtgaaaaatattcatattaggggtgtttcagaagaacaagtgaaaaggtgatgaaaatatatttaatgaaataatagcaaaaaaatattccaacgtcttgggagagagatggacatcaaggtccaggaaaccagataggttaaacccaaacagatcttcttcaaggcatcttacagtcaagttgttgaaagtcaatgacaaaaaaaataaataaacaaaatcagcaagagaaaaaagtcaggtcacataaaagggaattttcattaaagtaacagtggatttctcagccaggagagaatgagatgacatattccaagccctgcaaggaaataactgtcagtcaggaatactgtacctagcaaagttatccttcagaaatgaagaagaaataaaatctgttacaggcatatggaaactaatggaattcatcagcactaggctggctttacaagaaatgctcagtgaagtcttacaactggaagtgaaaagataacaactatgatcatgaaaatatgcaaaactatacaactcactggtagagccaatatattttttgaaagagaaaggaatcaaaccttatcactacagaaaaccacccaactgcaaaaataataagagagaaagtaagaaacaaagaatacacaaaacaaccagaaaacactcagtgaaacactgattagttcccacctatcaacaataacaattattataaatgaactaaattccccattaagaatatataaacaggacaaaaggatgaaaaaataagacaaaactatatactgcctattaggaaattcacttttcctgtaaagacaaacatagaatgaaagtgaaggaacggaaaaatatactaaatgcaaatgtaagccaaaagtgagaacaagtagctggaattatatcagactaaacaggcttcaattcaatgctgtaaaaatagacaatgaaggatattatatgataataaagagatcaatacagcaagagaatataacaattgtaaatatatttacactaaacaccagaacatcctgatacataaagtaaatattactagatctaaagggagagacagactccagtaaaataataattggggacctcaacattttattctcagtattggacagatcatctagacagaaagtcaacaaagaaagatcatatttaaacttcactatagaccaaatggatgtgatagacaattacataatatttcacccagcagctgcaaagggcaagattcttttcatcagcacatgggacattctccaggattagccatacgttagagcacaaaacaaatctcagaaaattttaaaacactgaaattgtatcaaatatcttatctgaccacagtggaataaaactagatatcaatgacaacaggaatattcataactatacaaatacaaggagattaaataagatgctcctgaatgaccaatgagtgaaggaagaaattaagaataaaatttgaaaattccttgaaacaaatgaaaacagaaacacagcataccaaaatccatggaacacagcaaaagcagtattaagaggcaaatttatagtaataaatgcttatatcaaagaactagaaagatttcaaatcaataacctattaatgcacctcaaggatataggaaagcaagaagaaatcaaaccccaaattagtagaatgaaagaaatagatcagagcaaaaataagcaaaaagactaaaaggaacaaaagatcaataaaacacaaagttgttttttaaaagataaacaaaattgatgaactaatagctagacaaactaagataaaaggagagaacactcacataaataaaatcggaaatgaaaagggagacatcacaatggatatcacagaaatacaaaatgatacaaataaatacaaagtcaaaggctattatgaacagctataggtcaataaatttgaaaacagagaaaatggataaatttctggacacacagaactcaacaaaattgaaccacaaagaaatggaaaaccttaacagaccaaaacaagtaatgagactgagtcaataataaaaagccttccaacaaagaaaagtacaggaccagatggcttcaccactcaattctgctgaatgtataaagaagaattaataacaattctcccaaaactatttcaaaacattgaagcagagggaattctttctaattcattctacaagacatgcatcaccctgatactaaaaccaaacaaggacacacacacaaaaagaaaactacaggtcaatatccctgatgaaaatatatgcaaaaatcctcaaagtactaaaaaactgaatccaacatgtcaaaaagataatacaccatgatcaagtggtatttatcccaggtatgcaaggataatatatgcaaatcaataaacatatttcacatcaatagaatgaaggacaatcaatagaatgatggaaaaaaaaccatatgatcatctcaaagcaaaaaaaaaaaaagcttttgaaattttaaatatctcctcgtgataaaaactcttaataaattagtcacagaaagaaaatacctcaacataataaaggccatatatgacaaatccacagctaacatcttaccaaacaagacaaaaatgtccactctaatcattcttgtcaaacacaatactagatttcctagccagagcaattaggcaacagaaagaaatgacaaacatccaaattggaaaggaggaagtcaaattctcttatcttattcccagaaaaacctaaagagtctacctaaacgtcttagaaatgtgatatggtttggctctgtgtcttcacccaaatctcatgttcaattataatccccaaggttgggggagagaactggtggtgggaggtgactgggtcatgggggtagatttcccttttgctgttattgggatagtgagtgagttctcacgagatctgtttgtttaaaagtgtttagcacttctcccattgctctctctctctcctgctgtgccatgtgaagaaggtgcttgcttccctgtcgctcttttgccattactgtaagtttcctgaggcctccccaaccgtgcctcctgtatagctgtgaaattgtgagtcaattaaacctcttttctttataaattacccagtctcaggtagttctttatagcagtgtgagaacagactaataactaactgataaaaaaattcggaaaagttctaggatgcaaaatcaacatataaaaattagaagcacttctatacataaacaaactagctgaaaaagaaaccaagaaggaaatcccatctacaacagctataaaacaatacaataaaatacatagaaatcaatgtaaccaaagaggtaaaagatctctacaagaaaaatataaaacattgatgaaagaaattgaagaggatacaaaaaaatgaaaagacctcccatgctcatgcaatcttgagaaaaaaataacaaaattggaagtatcacactttcagacctcaaaatatactacaaagctgtagtaaccaaagttactgcaaagtaaatgcagtatggtactggcataaaaacagacacatacatagatgaatgtaacagaatagagaacccagaaatttatttacagtctactgactttttacaaaggtgccaagaacgcttagtagggaaatggcagtctctccagtaaatcatgctgagaaaactgaatatgcatatgcagaagaatgaaattagacccccacttttacccaataaaaaattaatttacaatgaatcaaagacctaaatgtaagacccgaaatgataaacatattagaagaaaacaggggaaacacttcaagacattggtctgaaaaaagattttgtaagtaagaccttaaaagcacaggcaaagaaaaaaaaagcaaaagtagacaagattatatgtcaaactaaaaagctcctgcacagcaaaggaaacaacagaatgaaaacacaacctacagaatgggagaaaatattcataaaatatttatccaatagggaattaatatccagaatatacaagagactcaaacattccaacagcaaaaacaaaaaacaaaaaaacaaaaaacaaaaaaaccctccaatctaataaaaaagtggacaaattgttctgaatagaaatttctcaaaagacatacaagtgaccaacaaatatacgaaaacatgctccttattagtaattatcaggtaaatgcaaatcaaaaactgcaatgaggtataatctcatctcagttagaatggctattataaaaaagtcaaaaataacaaatgctggtgagaatgcggagaaaagaaaactcatacactgtcatgcgaatgtaaactagtacagtcactatatagaacagtttggaaggtcctctaaaaactacaaaaagaactaccatatatctagcaatcccatgacttggtatttatccaaattaaaggaaatcagcttattgaagatacatctgcacctgcatgcttactgcaggattatccacaatagtcaagatatggaatcaacctaggtgtccaacaacagatgactagataaagaaaaggtggtatgtatacacaatggaatacattcagccataaataagaatgaaatcctttcatttatggcgaccttgatggaactgaagaacattatattaagcaaaataagacaggaatggaaagttaaatgtcacatattcttattcacatgtggaagctgaaaataattgacctcatagaagtaaaagaatgctcgaggctgctagtaggatacagaggatattagaagctgggaaaggtaggagggagacaggaatagggagaaatttattaaaggaaataaaattacagctagataggtgtaataatttctagtgtcctataccacttaaagattacttattaatgtaatacatagtttcaaataactaggagcttattgaacattcccaatgcaaagaaatgatcaatgtttaagatgattgatatactaattaccctgatctgatcaccatatatcatatggatcaaaatatcactatgtactccataaatatgtacgaacattatttgtcaatataaaaaaacataaaagaagtctaatatgagccagcaataactgtaacaaacaaatgggatctcaagctgcatcaatagaagtataacagttggcaagaaggagacaaaaatcccatttttctcagccctggatcattcctgccttgaggaagaagagtgtcagtttgggtgttatggcccaggatgtgaaaaattagaatttctgtctagacggcagtgaccaggaaggtgaaatgtctgaaaaatgctttatatgagactatttagagaaactggggtgtttaggttgtttaaaatgtacagtctcttttatttgtgttgtcaaatttcccaagagctgctgccttggaaaaagaatatcagatcactttccttttggacatgggggaccgtgaacacagatttcaagttggtataagaagaaaccctctaatagtcagtaattgtgtggaaatgagatggcctcttttccgagtagtgagaaagctgtcaaaggaggtaatcaagagacactggaaagatgttggactgcatagcctctgaggctcctcacaactccaattctgggagtactgacactcttttattctctcatcactactgaagaatcagagaagacaaacttgataacccaacagaaatctaaagccataaatccaaagtggcttatcccagaaaacactgcctgtagtccccaactgcccagcttctgcacctcttcccatcttttcaaaatgccccctggaaaatgggctgtgacatggaggactcacctttcttctcaaagtccaccttctcttcccctggatgtcccagactgtccagagtgtgggtcacctggctgccaaactcgtcctcgcgggagacatggttggcccgcctaggtggctcctcatcctcctcacagtcatagtcatccaggatgggagtctcccggatgggcacgccaatgacggaattgtgggtttgcagccgggatgaacggaagctctcccgcgcctggggacccagcagcacagatgggatgtagtggatctcatgagtggcttctgtgcttgcgctcttctgggggatgcggcgacgcttctgccaacgtcgctgggcgtacagcgccacggtgaacaccagcagcagcagcagcagcgcgatgaggccaccctggagcaggaaggaaggacacacaaatgggccactgttctttggaatcgagggctgcaggggattttcctgtccactacactctgccaggatccctgggtttggctcatagagcctcaggaaccaccagccgtggtttttaagctagagagacattgtttcaaacctggctttttcaccaacaaactatgtgaccctaggcaaacttcttcacttctctgagccttgctttccatagttataaaggttgagtaggaatccctgctcttccttcttcacaaggttgccataggaagcaaatcagatggataacggtcatgtcagagcaatacagatagctcagtggcaggaagggtcagtgctgcggcttcacacaggtgaatgtctgaatctagactccatctcccaccagctgagcatcccaaggacagttgcctacgctcccccagccttgcttcctcatctctagaatgagttaactgaaagatcatgagacagtagtaggctgtcttacatcttgctgcaaatataagatagcattattaaatcaaacataatgtctgcatagtctgtattttcttcatttttcagaaacaccagtctttaaatttctgaatttctataagggaactgggacaaagtaggtccttaacaaatatttggtaaatgagtgaatgaaaatgtacctttctagggctcctttaataagaatttcaaggtcaactgatatatatatatataatgtgtatatatatacatttttttctttgatacactcagctcctaaatatttgagtctgcattatcctacattaatttgaaataagctaatgtgttaatgcacatatcttacatgattcatgaaatactctggtctgtaagatccttcagggcagaggtattttcaaaacacgtctgtaatccccataacacctgtcatgagcttgaagttgagggtttgcattctccaggcctcccctcaattgttctgtgccagaaacctctcctctgatgggtaggccctcatcacttctcttgcttttcttcactttatactctgcttcatgtttgggagattggaagacactttgctgaatgcctgctgtgtaatccctagagtcaggaggaatcacccttgttgtatacagggtagagagaggcttcaaaaaatcaagagacccagaaactcagagagcaagtggcagagtaatatctgagccttactttttgtgtgtttattttgtttgtttttgctttttaactctagagcctatattctttcaatccacctgtgtggttgatggcttctccttggctatgatctcattgaaggcaaggacaaattctgacaactatctgtacagcatctaacaaagatgacagatgttagctgtgaatacattatcttaggggcaaaggtggctgctgttaaacacacctgtttagaccaagaagaacactgtttgctgaaatgggtcagccatcctgctgactgtatttgatattagaaaactggcatgttctatttgcaagaccctcagctcactatgctgaaattcagcacctccacagaggtagggggactgggtggataagaggactaagaggtggtggccaggtatgcaggtgtggctgatagctctgtagcaggggcccaagccctgccttgagttcagcagtgagctactttggtttccccaagaaagtttctctggatgtcataacataaaaacaaatgcacaaatcaagcaaagctataagtacgtgtatttatgtgtgtatttgtgtgtgtgtgtttgtgtgtgtgtagaatctattaaatatatgtgtaaatgcatgtgtataccagaggtgattatgtatatatcaccttaaaaaacaacaatgaatcttttttttcctctacagaacatatgatagtgattgctttgtgtcacaaaattatgtgtgacatgatattatttgtctgggatttttttgtgtttcagaaataagaaaagaaggagagggagggagtgaggaagagtgaagaggagagaggtgatagagagggagagtgaagagaggaaagggctgggggcaacactaatccttgataaacacaagggctgaccctctccttaacacctttactgaatgtttttttatttaatctttaagacaagactatgtgacagaaattagtttatgctgtatagatgaggaaaaggtaactcagagaagtaagtaactagcttgaagtcacacagtcaggatttaattccaggtccagctggattcaaagggccaggaagtggtggagctgtgactgggccccagctccccatttcacagcccttggttactgaacggcaattctcactgactaaagagagggaaggggaggaggaggaaagatggtgagggtgcatgaaaagggaaaaggaaagtattattttcaaattcagcctccagatgtgcaatgggtgcatcttctcttcagagaagattttcattctggcccattgatgcccctgggggaatctccttgcctgaccatgccctctgtcttctcaactttgggcatttcattcagtgagaggataaggtcttacatggttcctgggccttcattcctcatcccactcagtatatcccgattatggttgtgggactctgtggtcagatcccaggaccaatactgacctaggaaagatgaggcctaaccaacccatccacctgcaactactaatgccccttcttccttccttgtatcctttgccttgagagccttccagtagtaaatggctaagtgttggcatcagactgacatgattttatccaggttctactgcttagacactctgtgaccttgaccagtttattttatctttctagatctttggctttctcatggattaaacaaggacaagagtcataatgccacctcattgggtcatgaaggctaaataagatgcttgtggggtatttaatatagggtaggggcacatagtatcataggttgttagctgctgttactgtcaacagaattcagcaagtatacattctgtgttgaacgaataaaggaatgaatgaaggaatgaatgacttgagtttctggccctatatacctattctgcacaacttgccttggatccccaaatccttttcaatctggaccaaatgtttgatatgtgctctttcattcacctttacacctatcatcatcctacattaagttggaaactcaggcatagagacaaacgtcatttactcaagatagagcagctgagattcaaactagctccagcatgactttaaaaccatgctcggagtggagaaggcacaggagcaaaagcctacttagcccctgctcagtctcacttctgccttatcaagttacctacacaatttcaggcacagatttctcaacataggaaacttccagaagaatgtggcagagggaccccctggtttgggaggcactgagcttgaggttccctttagtttattgacccattgattctttagcccttgaccttgccatttgatatgagcccaagccagtggctatggctatccctttagggcacaggttcattgtcctcactccccagcctgccctgaactcagcttccatcacctccaactgagtcactgaccacgtggtttccgttacagattcaagttttattgcaagaacttggtcaaagcagatttccagtattctggggctcatcgtgccactgactactgaaacagacatcccaggctgggcttctaaagaactcaggaggcatcatctaaaacatggtagcagcttaggtaacgttgcaagcaccaatctgaacatccctccctccctagaccctgaaaaagtagtggaatacataaaattggacacagtctcagagcatgtgggaaaaagcttctaaattcaagtttacttactttctgaccttggcttgctcctatggaccttcagtttattaatcagtaaatcggagttggccaatacttgtaatactatatcacacagttagaactagctaagactgggagtcagaaacacaaggttgaaatctaatgctgcacatataagctgggctatcttggacatagaacttaatttctctgattaacaattttattatctataaaatcaggtcatagacttctttatcaagggaagtgagatgtgaactaatggacacgggatactttgcttagtgcctggcacatggtaaaccagtgataggagaaaatcttcattcatggtaccccctataggctgctgtgcaaatcaaatctgaaaacagctgtgatatcctgtaaaaactgaagagtgccgtgcacaagcaaaggagctcaagagaaccatctggctgcttctgtcatagtgagacatctcacccaaagaatgcagatgagtgactcagaatcaagaaggaagtgtagactgtgtccacctgcactggtccaggcttctgtcctggtccacacccatagaattacatactcccttctttaacagcttcccacaccagaggtaagcaaacagaaaggcaggagcaatcgaccagtgctcagcacggccagtgtgtccagcctctgagtccacaccaggagcaaacacaggcccaagcagtggaaaaaaatgctgcacggcaaaaggggagctgaggaggaagaaaaagacctaggaagatggctgtgaatttttagaaagcaagttaagaagaggcgaaatctccaagggtgacaagctgagaccctgctggcctcagggacgatctgatgccaagtccgatttgtaccgtgctcactccagggcagccctaggcaaacaaggctgaggaagtcactgcaagttctagaaataataacatcagtctattagttacagggttgcttctgtgaggttgtaagctggacagatcttggggtgatttgtttttaccatcaccttatgagaatttcaagaagctttcagggaggaagtggagaagagatgtgagaaagaaagtgcacccctatcccttctggaaccttccctattacaagtctctctaggcaggatcagcctgcttctcttgttctattactgacagtgagtctcagattccccatgggaacaagacaagggtgagggtgggaggtgtcaagggcagagtgctctgatggggaaaccaggtgcctgggggcatacaggccagcatgagaatccctgcttctctccttgctgttggctgtgacaagttcattacattttacttccttggactgcaataggctccctttaaaatgaggctgatagttcacagtgtgaagagttatgctaaggattaaacaagacattcaaaggtctggataaaggatctggcaccacaaaagtcaacaaatactagcatcattccttcagcttccctatttgtctatcacaaaccaaatcctttcaccccagttccccttgcttaaactcctctcctggcttcctggggtccttaaaataatgtccaggttccctagcctggtacacaaaacccctcatgactgggtccctgctcattccccagctccccacaagcctcacctgtcctacttgtcctggagtcaccctgggcagttggcatcctccaaagtgtgatgctccctcttctgcactctctatcccctcagcctgaagcaccctctcactcactcgacctggaatctcagaaggtgacttcagttggaaataggatatttgcagaggtaattagttaagatgaagtcatattggattaaagtgggccctaaatccaatgactggtatcctcataagaacaggagtggacacacagggaagaagctcacatgaagatgaagacagagatccaagtgatgcatctacaagccaaggaatgccgatggtcatcagcaaccatgagaaactggtagaaaggcatgggacagattctccctcagagcctccgggaggaggcttgctgacatcatgattttggacttctggcctcctgaaccatgaaagaataaatttctcatgttttaagccactcagtgtgcagtaatttaaatggaagccccaagaaactaaggcactgcccttgacctcttgatctcagcccattcagctgtctaagcttggagatcacttccccagggaacatctctgcattttcaggttgaggtgaggctttcatggctccagtcctctggctgttgttatccaatcatctgtttgaccattttcccattcaaggtcttgagttgccatttacctctaccatttatccagccttagttccagtgcttagcccagggaaggtgcttaataaacacatccagaagctgacaatcttcaccagactttccagaggaatgcaaatgcaagtacttgttttagctctgatcccagcatcaacaaggcacctgaccaaacctcgtatgcccctttgctgcttttactttctccaatgccagtgccttcagctggttttcttacgtacacaacctcaaaaacagaaaaatacacagagagataaaaagtataaagcacttcaaaccaccccaccaagagagccttctgaaaagtcaaactcagtacactgtttggcctggcctcattttaatctatttttcatgttaaaatatcaaggcatgaaagaaggaagcagagaaaggaaagaaagggataatatgaaaaatgctttatttgacaatgtgtcattcagaaactgattatttctgtctctggcctttttaatattccctcactatggccaagccaccaggggatttggtattctaagactggatttataatactctgttctgcagtgataagaacacaggcctttaatcctcagagctgtgaacatgcatattctctcaagtaatgtccttctcttctcgtcacttgtttctggtccctggcagccacgatgccatgatggctgagaactggtgatccactgggccttctcttggccacttgcctaatgacagatctagtggggaagggggcccgggatccaagtgatccgagacgtctcctttcaggccccagtctatgtttaagctggaagaattattagaaaatagtctaagtctttagtgttagaagaaaaaaaaaaaagaaaaagaaactgagactcaaagaatgaaagtgacttgaccaacatcacaaaccatcctaaaatagttctggagacagaatatgcagccgactccctccaaagctgctaaggaaacgtgaattgtgacaatttgatctacaaaatagcttctataactttccatttctctctactctatgactgtcctatgccctagttttcatggattttcatcatgataattttaatacatgctgaatgatcttccaggctttattcctcctttcccactatgctcaatccatcttacttaccgtaactaaggcacacatggaaactgatcccttccccattgactaagctaagaatcctgtagtttgacagttcaagtcctcatcatctatctttgtggataaccttgtctcgaacgtatgcttttgaaatgcccttcttcaaatgtgtgctttggccgtccatgcaaccacccctactaagctcttgctacagagaaggcatggtgccaagtatccaaccacagtgaaactctctgctcccagtaagctggggagcagagactggggcctgaaaggagacttgtcagagtacgtggagcctgagcctcctttcccactagctctgtcattaagtgagtggcgaagagaaggcccagtggatcaccagttctcaccatgatggcactgtggctgccagggaccaaactctcagtcctgaggtgtttttgtagaagccatttactttacctggaatgatgccctcattcttattcctcacccttatgtctacacatccaaataccacccatacttcactgttaacttcaatgcatctactttatgaactcctaggcttttcccttccccaggtgcagccagaaggaatttctttatcctctgcactcccacagcgcttcgccttaaccctcacttaaggatcttcagcatttcctaccttgtattagagttgttgatgctctttacttagctgccctacaggttagattattatgcccagtgtacagatgaaaaaaaaaaggagactcagaagagaaactgcttaaaaccatacaaccaagtagaaaacatatatgataagattttccactgggggcaattcccaataaaccatgggttcactatctcagaagggagcagctggagaataagataataagaaagttcagaacatattgcaaaaggcataaggatctaaagacttttagacactgaggatctaaaatttttttatgccgtagggtggcaaaatcagctgtataccttggaaagatcatagtgggcatgatggggagattgaaaacagggataccattgaggtagattttaacaagggtctaggatggcagttctcaactggtggcaattttgccccccaagaggcatttggtaatagagacatttttggttgtcacaacttaggggagagagtactggcatctagtgggcagaagccagggaatctgtaaacatctcgcatacacaggacagccacatacaacaaagaattaactggtcccaaatgtcaatagcgcagagtttgagagtccctagtctaagagagatgatgagaccagaactaagagagttaaagtggtgggtcagctaacaggataggaagacttgtgtctattggtggggaagggggtgtcaacaatgacactgaggtctcgattctgtcactggattagggagggacctatctatctacgtcttattttttcttgggtaatcttccagaaagttatacaagataccagcatgtaatcaaatgaagagatacatttacatgtgtgaacaataagggaagaaaaaggcacaacaaataagaatttgcatgtatacatgtatgtgattatgtatgtattcacatttgtaaaaatatactcacacctatgttaatacatctatagttagctatatttatctatatttcttttttgcctctagacagatatacggtgacctatttaagaagtcccattatataaaaagaaacatgtttctctttaaaataaatcatctacttaccatgtatctattagagatactattttacttccaaagataatgccaaaggagtaaagtaaaaacacattggttctttggaatgcattcaccttccacccactaccccccagctcaatcttccttaatcatctttagatcagattagaacagggtcaaaatcctgggagaacatactgaattctataaaaatttatcaaggagaaagctaaggaatgcttggagacaccagcgttttcccgtaagttagacagacataggttcgtctattgacatttttgttagtacagtcatgactcaaatctatgtctgtttgacttatatggctttggataagtcacttgagtttcttcagttctctcatctgtgaattgggttactaacacctaagtgggagaatctgtggaggattaaatgcgattgcagtgtataacacagttagctaatagcttgcaagtagtggatctttattattgatgtaagaccttgtttcctaaaaaaaaatttgatacaaagtagtggtgaaaccactacttcccctccactatacaatcagatattctctatacagtttcccagctgcattcctcccataggctccaagcggtgattgtgatcccttcccctctttggggtaagtaggtgggattggatggtttctgacagccatcccagctctaatattctagaaaattaaaaaagcaaaggcaaactggaaagcgttttggaagagatgaaatacatacattcttatgacatcttgcctggtattacaggtgtaaatgcatacattaaaacagttaaccacgctgtatccttcacaccatttcacgtttctgtgcttttgctcatgctccctctatctgaaatacccttccctcacttctttgtcgagtcctttaagcctcagcttgtgggtcatgagttctctgaaacctgctttttctgactgggttaagtaccacctgttaggtcttgcagtgactcatgcttttgtctgccagagcatgccgcagattgcatcatagtttgaccccctcccatcaccctagtgcccattgagggtgttcttaatcatctctgttttcccaggatccagctcagggtctgacactgagtagccctcattatgtatttattgtatttctacactgagaggcaatgaaaggaagggcagggttttatttatttctggttgaatttgaatggtacacagcacagagtagtagatcttcaattacttgttgaaagaaaggacgaataaatccatcataaatgcctctctaagggcaggtgaccaaaatacacctacatctgtctggcagtcctccatctgtctgtaagagagggctgaaggtaattcgcatgagccatttaacacaagtcagcatcccactacatgtcctcaggtggcctctcaagttctgtcgcaaatcccactctgaaggacgggtgaatggagaaggtaggggaaaacatctttaggaggattgagtttcttcccactctttgagtcatgaaaatatacagatgggccaggcacggtggctcacgcctgtaatcccagcactttgggaggccgaggcgggtgggtcatgaggttaggagttcaagaccagcctggccaagctgtatgtatatatatatatatatatatatatatatatatatatatacagatgaacccaagtggccagagaggagctttgccctcattcattgatttacttattccccagggtaaggtcatacctggaagcaggcagacctaagttcccatttttactctgccacctaccagtaatgggaccttgggacattctctctgtgatgctcagttttcacagctctaatacaggaataatgccattcaccaaaaaggctgttgtgaagatcggataaggtgatatgtataaaatatgtcacacagcccttgacctgcataaaacattcaatacgtggtagtcattggcttaactcttactactattattgtaattttctgaccctgtagcaaaccttctgcctcgatttagaaatacacaggtatgcccttgaagaactcacagttggtttgtggcaacaggtaagtaagcaggcagttatcacaatgcatagttcagcaagctccatgtaagagggaaacatggtaaggggcaaagagtttctcacagcttccaagtgtaaaacgtagagaaagtgaggataaaaaagatttttcttgcaattccaattacagtcaagttcaaaggtgtgaagaacatgcccatccaatcaagtacactcttgcccaaaatgtgacagaagactggataatcagctaaactgtgtagtggttaatggtgcaggctctggagttgatggccttgggtttgagtacctgtgctgtcatttaccagctatggaaccttggataggctactaaatttctctgatcctcatctttctcatcttaatgagactaacatttcatcactgaaatagactattgtgaaaattaaacaagtgaatgcaaaaaggaatccaacagtgtctagaatacagtcaatgctcaacaaaagatgatttaaaaaattctggcagaggaaaaacatattgagaaagaaaccaggcaacttaaatcccagtccttaccttacccccttataaagtaaaagaagtttgcagaaagctcacaggtcctcataaagcgggtttgtttgtttgtttgtttgtttttttaacagggtggccatagcaagcaaatgaactaggcatttctaacttcattaacagatgacaaaagtgagcctttcaagaggggttttgcccttcaaggctgaaaagtcagtgacaggacacacatttggctccagaatcctgtttgtctgctgcatgctgctacaatcatcttgaaatgttcggtgtgtctggagagtcggcagaatgaagagccttcatcctttgctcagtacattattccctgggaatgtgttgcagattcacagggctgatgtgagatccctaatattgtgccaaccttaaaatactgtgccaacaacaaagccttctgaggtcagaagtagggaaaagagaggaaggtggaggccagtgagagcctggtcaacactaatacatgaaaaataagtttcatatggggagggagcttctgaagggagctggcagcatagtgggtctgatgctggcttctttagaaatcatgggtgggggttaggggagttggtgtgggtgagggtcatggtcagggattgctgatctatcaccaagacagagtcacgttggtgaaggcttccctttgcacctgctctaccacagtgctcttcacctttgtctccatcaccagatctctatttcctttccttgctttaactttatgtcacttatctctcacttttattatattacacactaatttgttaactttgttcatggccttaatagaatggagcttccataatgtagggccttttgttttgttcattactgtcttcagcaccaagaacagcacttagtgttttgtcaatgcttagtaattctttttggagtgtatgaatagattaatggatgcagggatgggtggatggatggatggatgaatggattactggatggatgaatacatgagtaaatagatagatgtctctcagaatggtttagtagctcctcaaggacaataactagatatgaattatttattagcctatacccgaggaccgaaaaggctggaagatatgtagtgaataaagaaaacattgctgttagttcccttttggtgcccaggtaaggggtactgggtatagggataatgaagacacaaatgtgataactaactgttaactcctctctctctactgttggaccaaagaggaagaggtggtctgaattccaagcttgtttagtcatttatttatttataaatacttagggagatactgagccagaaagtaaaggggtgaaagggatgtcagatgcaactcttcaagcacaatcactttacacagaaagcaacctgatagctgtatctatttgttattactattactatatctagatggaaatcataggactttagtgaaagagggtgtcaataatgtggctcaaaaaacactggatttgggttcaaattctgactgggtgattagatgtacattccttggctagccatgttacctttttcagcctcagtttccccaggtttaaaatgatcaacaataacaggtgccttttcctctttatgtaaggacttcattgataatcatgtttttaaaagaactatatatgttatagagtaatttacacccatcagaactttgtatataggtgtttgttaaagagagggactccaaaaaccacaggtaactcaagcagagtaacttaggcgcaaaagaaacaaagctgcaaatctgccagctttccaatacttctgatacttctgtcatctatccatcaacctttttcaaaacctattacaagtcacacaataggggtctcttagaggcattgttttgctgccattttacagcattgatgctgtagctgccaattgtcttgacggcatgttgtgatggtctcaggatctcccctaccgggctagatcaagaaaacccctggaaagttagttactaggggcagagagtcaagcataagatgcccatcaatgagaagggaaaagagagaggagtcaatgggaggtgctctgtggcatgataggaacaggaattaaaagctggccagtgtccttgatgtacccaccagggctgagctggtatgattcattctttctcttcaccttgctgccctttgtctcctgagtatttaaagacgtggagttcaggccagtcttggtggctcatgcctgtaatcccagcactttaggaggccgaggcgggtggatcacctgaggtcaggagttcaagaccagcctggccaacatggcaaaaccccatctctactaaaaatacaaaaattagccaggcatggtggcacgtgcctatattaggggggctgaggcaggaggatccttgaacctgggaggcggaggttaaagtgagctgagatggtgccactgcactccagcctgggcaacagagtgagactccatttcaaaaaacaaaacaaaacaaaacaaacaaaaaaaaccatgaagttcaatatctcctgagtaatccaggtagtagagataattgcccagctacctgtcaccttacccttaacaactcctctcatccctgagataatttccacccctgctggcaggacaggcaacccagggcccaggctgcaggggaatctggtagaccatgctttctttcctggttcagagaacatctcagttgtaacactgataacgctccccgcccccaagccctaccatgagtgctgaacctcgatctgttccctgagatcttgctgtcacacacaggactgccccaaggtggatctccaagtcctgctccccacattccctcgggttgtacatctattgccttccaagacccaccctcatatccagctccagctgggctacccaagactgggcagtctccttaactgaatcccagggtaaaatacaggaactcaaagctccagcatattgtatccttaagtggtcagcgatagcgtccccaaactgccacccaacaggacagcatttgaagcactcattgagcctgagattggaaagatgaggtctggaagagcctgggaactgtctaaacttcagattaattagatgaagatgaacttaattccacagctactgaaataaatgttcatgtcacacagccgtctccaacccatatcggtgaggggtctgggctcactcaagaacaactagcctgggttcctggcccattcagagtcctgtgtgttttgaaccaaccagcaggtcctgaggaaatggactgaggtggaatagggactggtggtattgggaccacttcagagaaagtctttatttctggccaggtgtggtggctcaggcctatactcccagcatgttgcgaggctgaagtgggagaatttcatgaagccaggagattgaaactgcaattcatgagaatttcacgagggtaggagattgagaaacatagtgaaaccccatctctacaaaaaataaaaataaaaaaaggcatggtagcgcacatctagccccagctactcaggaggctgaggcaggtctgcttgagcccaggagtttgaggtaagactctatcttaaaaaaaaaaaaaagccctattgatcctgagcctctgtggaatctgggtgtgtgaatttcttcaggctgaaaaaaaaaaaatcacccaaactgagtggcttaaagtgttagatatttatctctcttagttcaggaggccagaagtctgaaatgaaggtacaagcagggccaagctccctccaaaggctctacaggagactcctcccttgcctcttctcacttctggtggctcctggaattaacctgtggcagcatcattccaatctgtctccatcttcaaatcaccttcttctcccctgtgtctctctccatctcctcttcttcttacaacaataccactcattggatttagggcccaccctaagtcagggatgatttcatcgtaagatccttaattaattacatctataaataccttatttccaaagaagattatattctggggttctgggtagacatcaattatgtcaggacactattaaaccccgtacactgaggaaggatatctaggtccattatttagttgcaagagtcactgaagcaacccatagtaagtgaaccaaagagattgagccaggaaagaaaaggtctaagagagaatgaaaataagacctcttttctcattcctcagtggctattctggggcagagggagcggacagtgcatgcatcatggaaaggtagcatcatcagcaatgacgaaagattccacagagaaggctgtggactgaaaacaatacaaaatatacaataaatcctttctgacacagtaaactccactcgccttttaagacagagcttgtgtatcttcttgaccctcccagatagagttgatcatccccaaacttgcctggtcataaataacacctggggatgctcattaaaaatacatatttctggcctttaaataagcctgcaggagaccttatcatcaggtagggttggtctgggagcagaagagtatttaaatcctatctacagcactctctgagtttctgatcacagcaggtcaattgattcagtatatctcatcttccttgtctgtgaagtgatgttagcagtagtatctactttaggattacatgcatcactctgctgagtgatgaaaaccatagaaattcttagtaatagagagccaggactattgccaagattacagctgtctacaatggccctaggccactctttggcatatatttgcctacatacctgccatccctgactagtccttcttatttgtgtatgccaatgtagcttcttggttaaagctcagactctcgatccatgaaatttgagttcaaatcttattgctactctattggttttgtggcttcttacaagttactttattctgtatctagaaaatggggataagcaaatctatctgatataattgtaaaaataaaacaaaataatcgatacattggtttgaattgatttaaaatccaaaacagaagtggaatttgtggaatttggggaggataaagggggaaggagcttgttgtcactggtgaagtccaagaagccaacggtttaaggagagtttggaaaggggagaatagaggcagagagagtgggaagcgagtgaggaataaagggagcatggaaaggaggggagagtgtaaggtgagagaggatagaaggaagtgcaggagagtagaaagaagcttctttttcaagaatcccagtggtgttcaaatcccatttctcaggccattacaaacataagaatctcgtctattttgctcagaatcttcttccttgttctctgtcccgacctagaggctgctgacttgggctgtcagagggccactaagtgagcacaccttccttttctcatcattgcttttcagggccctgcactcggggaagcagcccagaaggggattagaagatctgtggagacagagctggagtaactgtcttcaccctgccacctccatggggctgtataacaaaattacaaaagccacccagggtaagtgctgctacaaaagtaacagcaaaaggtaactgtcaattacaaaagcatctaggagcctcattttactcatccgtttaatgggcatcatgagggtcccatgagtgtattgtcttgttttgaggattaagtgaagatgtgcatgtaaacactctggatagtattaggaaatgtttcttctttataccccaggttttgatcaagataaatttcccccaaatctctctcttgcccaacatcctttactcctccccactaaggtagactggatctggaatgaggctgtgagcttgcataactctttcccttcattgcttcttttgccgtaggaaccagctgccctccaaaagcagccttctgctctgccctgccaccccttctgttttgtgataacagattcccatgtgagagggtgccaggcactcagcacttaccctgggtgggaaaatacccatttttgccaagtcctccaaactaaccttttgcagtaataaaggcaaaacattaatctccatctgctttactccttttactaatctttcaaactgttctcaattcaagtggagaaaatatggggcttccacaaatcccatgccgattacctgggtccaaagaatgttctcagcaaattgttctgttattattacattcaccagaaactctattgtctcttctccctttgttgggagcaattttttttctttttttaatttatctctctaaaagctttcacattttcccccttttatccatacagttctgaaatttcactgcaatgcaactaggtacagatttttttttttttcctttttgttcctcattcatcatgtttggtaatcagaggacactttcaatctgttgttccttccttctgctcagggatgagttctggcattatctacttccttccctggctctgcctggattctggagctcctctctttgctgttaacaagcaagtcttctaggaggtgagctggagcttgcgttcttccagtttcaatctcacagcctccctgcatccagggctctgtgtccttctgaggggcagagagcaggctgagaataaaactcctgaagaaatcagggaggggctgcaactgggaggaggccctgcttccaattcccccaagcgagcatgtgttcctcgctccaaagcaggaaatcaaacaaaattgctggacctaaaccagtaccaggctcagtggaagccaggaactggcaacttaatcctgttaatgagattttgggcaagtcgctcaatacccccttagcctgattttcctcatcagtcaagtggcaacaatcatttaccttccctgactcccagggtggttgggagaatcaatgaaatgatgcacatgaaaaagctttgcaaattactaagggctatctatgtataagcatatgtgtgtgtgtgcatccaaacatacacaacctaaacataccccaaaatgaacatcaaattacagagaaagactgaagtctgttaagcaaatttctgctcatcttttatgatccagttgaaatgtccctgcttctatttatttgactcagtgcctaaaataattagcttgaatttttttttaaaaaaaagaatatagtcaaacaaaggaattgcacttatggcagagtggtgatcactgaacagtgagcaatgagactgaccaaggaagaaagcagttttgtgttttctatcccatcttcactgtggattatcaatgctcattgagtgtaacagtggtcataataacctaaccgcctaaatttctgtttctgtgtctcttgtctctcataaaaaatatataggttaattcatgcaaataaaatgcacatttgataggactctactcttacaaaatgcttcatgtatctgtcctatgaactggagtttctcataagattctatttagaccaatgactccctgctaaaattgttgatggactatgtctctcagcaacaggagggtgactttggagtgtgttgtatccaaaagctgagcagcagaaagggggagttagatgagatggtatggactatgtaagtgctcagagggcaagagggtagagacaactcctctcctcccacagaccagcaaaggcagcagtggtactcagctgtctgccaccagcctgaaaagggagcctcaggcagggacagattgtgtttgggttggagggtaagagtaataactcagcagagacaatacagacgtgcttggcatattcggaccaccttaccaagatctcccctcccatttctcctccacgcctctccagcgccagctaatccctcctgaaccggccatgtgtctcctaccgtgctgaacagatgctcaacagcagctagaaggaaacccagtggaggcaaacacactcatctttctaaactaaaatcccactttccaaatatcagaacggacaggaactcagagatcttaaggttagctgacattgttaggattatcactgcttttgtacactttcctttgaaaaattttaattggaaattcatttctgaataaagccataaaagaggcgctgctccagtctaaatggaggttgggggtctgaaatctctagagctccgtggagcagagctagaaaaaaggactctttcattctgcacaagggaatgtcaaggctgagagaggatgagagccttttctaggtcaggcacgattagtggcagagccaggactagaacctggccccttggtggccatttcaaggtgtgtttccattgtcagactcaagacagaaagctgtttaaaggtgatccatatatcagcgatttcaagggttttaggtaagcaatcggtgtctgctgttttagtgtatttaaagaaggataaggctgggcgcagtggctcacgcctgtaatcccagcactttgggaggctgaggcaggtggatcacctgaggtcaggagttcgagaccagcctggccaacatggtgaaaccctgactctaccagaaataaaaaaattagctgagcatggtgacaggcacctgtaatctcagctactcagaaggctgaggcaggagaattgctggaacccaggaggcggaggttacagtaagctgagatcacaccatcgcactccagcccaggccaataacagcaagactctgtctcaattaaaaaaaaaaaaaggcggggggaggataaaattttattttccaagcccctattgcatgtcatttattggtattgacaaattgaatgcattattaaaacaaatcaatcctcattggaaatctgtgaggtcagtgttaacatacccattttgcagataagaaaacaaaaaggttaaacaatttgctccgggtcacgaaattaatctgtagcagccctattattagaacccagacctctaagactcagaaaatcatcctgctctccagaaaaaatgtcctctcatctgaaagtgtattactgtaactacaagcaaacaatgtaaaataaactactactacaacaaaatggcatttgcacagtccttaggtttaaaagcctttcccttcattagtacctcatttgagcagctctgtatcacatggctgggtctaggatgaggcaagtgggtacttgtcttgtatgcaaaatttaaaggggttcaaaaacctcagtaatgaagataatatttcaatgcaactcttttttttttaaatacaagttaatgcattcctgagtttataggcaaccctttaaattctacgtccaaggtgagtgaggcactcatattctttgctggtcctagccctacagtttgcagacctgtgaaacagggagaaaacatattttcataccaattgtgcagatgaggaaagtgaatctcagatacattaaataacattttcagagaactaaaggcaggtctttctgacttgagctcagaggcctggagttcatcttaatccaaatccagctgtggctctctcaaccctgggaatctggtgacataggtatgttggggtagggaatagagctaagtagcattatactcaccagaaaactgaggcacattcaccaaatgagttatccaagacccatggctactgtgcaacagagctcggaaataaactcggatggaactccacactcaatactgccttccatcattaccaaaacacgaggactaaaatgttcttgaataatacacaaaaattctgaggtgctgcatgaatccacagtcagccacagtcctggaacagtactaagtgggctctgtgattgctaccatcatggggaggtcccaaaggcttcatccctgggccagagggagtgagatggagagaagctggcagtagatgggcattggaaaaaatgccacactatagattggttggaaacttgttcaaaaaaaatgtgataagcaatgaagagggagctcagggtgggatgtaggaccccaggggctggcagtgacatgtgattctccttctgtgctggactgtagggtccatgagggtagcggtgtttctgctctcaagcgcctgaaatagtgtcagtctcatactaattgctcagtaatgaatggatggatggatagatggatggacagaacactttaagttcaatagagcatggtgagccccatttcctaaatctgactcccagctctaccattgatcccatgcaaagggtatcctctctctgctttagttttctcacctataaaatgaacacaataattctatgtaattcatagggatgttgtaaaagtaaggtaatatatgtcaagtcctagttatagcgtctaacacctagtaaatgctacataaatattagctatgatccgtaaagcaacagtaaagggagttatcccagaaatgcaaaaaatatagggatagttgttattttgtgttgtgtacctgacattagtccaggtccaattgccagtctcagattataaaatgtggaacaatgccaggatcacagagtgggtgagactaccattcttttggcattttctatctgccagcccctgccctacccacttagagtatattattttacttaatccttaagacatgcttctgaaatattaggttggagcaaaagtaattgtgattttgccattacgttcaatgacaaaaaacgcaattacttttgcaccaacctaatagtttctattattatctatttttttttataggtaaggacactgagtctcagaaatattagaatatttggtcaaggttgttggaagcaggtctgagttcttgccctccggcccagggatgaagcctttgggacctccccatggtggtagcaatcacagagcccagttagtactgttccaggactgtggctgactgtggattcatgcagcaccttagaatttttgtgtattattcaagaacccaacaactctggaggctgagttcttcttttgagacagagttttgctcagttgcccagcctggagtgcaatggtgtgatctcagctcactgtaacctccacctcccaggttcaagcaattctcttgcctcagcctcccgagtagctgggactacaggtgcatgccatcacgccccgctaattttttctatttttagtagagacaggatttcactgacttagccaggatggtctcgatctcctgaacttgtgatctgctcaccttggcctctcaaagtgctgggattacaggcatgagccaccacactcagccgaggttgagttctgcctgtgtgccatgtgtgccatgctcacagtgtttcacttcactctacctcccagtgggcccaggccccatctggaaagggaggagtcagagaggagatgctggtgctgggtgcttcctccctcctactcatagatggctgctgctctcaggctagctcaactccctggagacacacagttgtctttcccaaggaggctgacactggggctgccattggtcatagctgagggaaggtgacacaagtgatgctgcacagtgaaatccaccatctcatgtagctccaattgcaacctggctccctagaaggaggggagaggctgttttaataatgatacccctgctccttgtggcgggaaggaaggaagggcaaagacccacttgtggaggctcaggctttcctgagctctgtgcactggctctcctggctcccggggatttctttaggtcctttggtttagccatgggtgtctacagccacaggaaaagagtgggtcccctctgcactcaatggggatagtgagatgtcagggatataggtaaccgagacagaattcaaacccaggtcagctcaactccaggaggctaataagtgacgttggtcaagtccttgcccatttcaaagctttggttttcctatctacaaaggagaggattgtaccagatgatctccaagggtcctcccagtgctgaacctgttatgaatgtgtatactgataaatccaaggccaacagctctggctctggcccaggctatgggtgaatctcctccacaaagctcttctcagttggccctcctttcattgagcaccttcagtgatgagaaactgattattccttgatgatggagcaacctggggagaattttggatgtcactgactttcactgactagttgcttgacttcagagagtggactcttctctgattctcagtttaatcatcagagaaacatgaatgttggtgcctagctccagtgaccgctataaagattaagttggctagtaagtgtgtgtgaagtttctggcacccaataacaccccaacagtaattttctccaagttgcaaggtatcaccctgccaagtagaaataaacaagcaaaaatgggtggagggaaataatgctctgtttacatgcagatattaaaatatttccagtctttctcagctataagatattccaccacacccaaggatcagccaggcagcatgttcttctttgcagaactttagatgcattacttcatcaatgtaaaaactcaggcccagagagtttatctgccttgtccaaggtcacacagaaaatcagcagtggattcagattcctgaatcccaagcttgtcatttcttcatttggggaaccaagaggccctgccacccttggctgacagcatcatccccttagcaaaaggcagctctgagtccctgcaacaaatgtaagcagtgtctcctaagcatctccaaatgccaggcattgggctaggcacctgaagcacagaaatgaataagaagtggccccctcctccccagaggattacaagttggggagagacaacaggaggaggtggtaaaacctgtccacatgtttctataataggatcttcatcactccattattccccttctctctctataaaagcccagagaagcaggcagatgttggcaacatctgggccactgttgtcggggcagcaagtggctttgggctgccattggagaaaagaagctgttggtgttaagaataataataaagagctaacatttgcatggtgtttactcctgtttcaagggataacccccctccatcccatccccattcattagcccaagcaatgcagacagcagctctctgaaagcctaggagaaccatttccatttctttgaaggcaaagccaaggctcacagaagttaaacttcctgcttaaatcacagagctcataggagagtgcaggcccaaacataaaagccccatgactcctagattggtgttcattccatatgccaggctcaggcatgcaagtgaatgcaaaaagataggtggtcctttctctaaacataaagaaagcatttgctgtgtgtttactaggtaccaggaatggcattgtgtggttagtatgcttaactcctttaactcttccaacactatgagataagcattccagatgttccttgacctacaatgggtgttacatctgataaacccattttatgtcaaaaacatcataaattgaaaatgcattcattaccccaataaagccatcataaagttgaaaatttagaagtcaaccatagtaagtcaggggccatttgtagtttcatacttttttaaaataaatacagaagttgagattgagagagtttaagtaatctgtctatggtcacactggtgactaagatgggtcactggtaaagtgggtggttcagtgacgtggtgagaagagttgggataccatgttccttgtcctgtcttcctcataaatttgtgacactcttggtaagtggcaaagctgagatttgaatcccaaaaacctgtcaactttgggtgtgactgtgtgtgtgacagcggaagggaacgaggatggttgaaaaaggaggaactgagccttgaataggattcttccaggataaagaacaacagcacattgcaagctgaagcaatgctttcaatgggttacacttggcatgccaaacataaggttggtatgactggagcagagtaagaaaggggacaggagaaagacataagattagggaggtaccacaaagccagatagcagagaaccaagacaccagacggtgagaataattaagtgcgggtactataaattcagaacagacactggagctaccccatagataaaccttctaacagacctgcccttcagtcttcctctgtcttcagctatgtgggccagtttttctccttaatagggatctctgaaagtgtttcctgaggttttccaatcctcattttgtagatggagtctaaagcccaaagaatttgcccagactcacatagcatatggggggcttgacttaggacctaagccatgctttctgcagactctttttcacactccacaccttatgttctcggcactcattttctgcatattttgaaattttagcataaggctcacactctctcaatgactgtctgagtcctgaggtttacaatcctcctttccatctgagcctttctgggcttcctctttgtccatcgtagaagagccactcaagatgagagggagaaaaggacaattctctctatgccagctgctctttccaagcctaaggccattcaaagctagtgggaccattcgctctgacagtaactgagacaaataaacaaaactccactgaggtgaatctgtccttttgatgcttttcagagttgacacagtagctcctcggagtcggcatgactcatgagttctttctaatggattagtttgggttcatttttagctagaagaaaatttgacaactgcactcctgaaaaccaggagtaccttctaaaggatccatctggtttcattcaagttagaggtcattttgacatttatatcagtgcaagcagggagaatcttctgaagtaggaggcctaaacacaaagacctatagagcagcatttcccaacctttttggcaccaggcactggtttcgtggaagaaaatttttccatggacttatggggggcctgtggttacggaataaaactgttccacctcagatcatcaggcatgagttggattctcacagggagtgtgcaacctagatcccttgaatgtgcagttcacaataggattcgtggtcctatgagaatctaatgctgttgctgatctgacaggaggcagagctcaggcagaaatgctcattcgcccaccagtggctcaaatcatgtggttcctaacaggccacagactgtactggtccacagccctgggtttggggaccacttctgtaaagcacataaatggggacttgagtagggtatcatagcagacaagattagggagtggtagggactgtggcaaattagagaacatgtgatccttctaaagaagtatctgctactgaaattcagccaattgtcaccatccaaaaatgcagactgagtagaacgtgcaagttacccccccccacacacacacacaccacacacccctatattttcatatgaaatttgacagtgaaaactttctttggcaagtcttttttttttttttttttttttttttttttagctgagtggcccaattgcagacaaaatgagactcatctgtggcctagatatggacttgggctcccagtttacaacctctgtcctatggggtccaattagtttcatttaacgtggagcttactttgacattcacattactataaatcctcttagagagtgtttcctatttggaatggttcccctggacatagcctacatcctcccaagcattcctatacattgctgggctgaaaattggcaagtttccacctagaggctataacctataaatatatctcaaacctccattccttttacactctgctggtggatataattgagtttctccctgtaccaaatgagctctgagttcttagtacttgatgtacttaatagaggaaagtcgggacgagtctggaaaagcaaggataacacagaaacagaacagggatatgctggctggaagcatcctaatggttttatcatccactgttagaagagaaaagcataatagtataactatcacaccctctgcataataaatgccttatggcaccctggccagcacatatacatatgggtggccttggagacatcatggagggtttagccactgctaccagtctattctcaagaggaagcaagtgggcctaagcatgactggagatgatgtttggtagaaaaacctgctgttccagaggcatgataagaagacttccctaagggagtcccttgatacatattatgtggtccccactggtgtgtggaaccaatcaagtaccctgggagctgcccagagcaaaagtgtgttttggaatcccacagggaactccactctgtgtgtcaccctctgtgtggttctgcaggaaggacactaaactatagccttccagtttgcttgttgattcctgcattctttcatttattcattcattcaataaatattaagtaattaatcatcatcgccatcgtcatcatcatcatcaccataattgttgttgtaatttattaagagtcttccatttttcaggcactttgcatttgcatagataatttccttcaattctttttgcaagaaacatattgctattcttctttcctaataaggaaactgaggcttagcaaggtcatgtgatatggacaaagttgcatagctaagaagtggcagagctgaggagtgatactatgttgtctaactctcgctgtggttttctcactacaaaacactgtctaataattgtatagtactttgttgtgtctcagaaagtaattatttaattctcataactgagaacagactgaattagacttattttacagaagggaaactgagtatcaaacaggttaaccaacttgcctgaggccacccagcaattaagctggtctcaagcataggtcttctcactgcaagtacagaatcgtttaaaataggatataatattcatgtttacaattccttcagtgataatgacaaccattaataatcctggaagttattaattactgatgcctcactatgtaccggaagccctgctaagtgttttattggaattcactcacttaatcctcataactatcctacaaggtcagtgtgactactaccatcataacgtcacttggctcgaagaattaaatgaaggttgcccaagctaggcagctagaaaatagcagagcaggcattaatagcaggtttatctgatccttatttccaactaaaattcttaaccccgccacccctccccatgatgtacagggcaggccttgggaaggataataaagcacattcagacccagacactgtcagatacttcaaggtggctacccaatatgcatttccctttcttccttagtaccagcccatgcttagtacctaaccatgatatggttagtttttgtgtccccaccaaatcatatcttgaattgtaatccccctaatccccacatgtctagggagagacctggtaggatgtgaatcatgggggcagtgtcccccactcactatcatgagctgttctcatgatagtgagtgagttctcatgagatatgatggttttataagcatctgacagttcctccttcacacactcatgctctctctcacctgccaccatgtaagacgtgcctcttccactttggccatgattgcaagtttgctgatgcctccccagtcatgcagaattgtgagtcaattaaaattccctttttaaataaattaccctgttttgggtactttgttatagcagtgtgagaacagtctaatacagtacacctgtaactaacaactacatctcagtcaggtggctatattctggccactgagatgtacatatacatactaggagaaaagctccttaaaggcaactgcctcatctgggaggtgtgccttattatcgatttatttttctctcccttcctgttgtttgagtagtgaacatgataactgattttcctacaattatcttagaccatgtgagtctaaggatgatccacatggtcttatcttagaacagtggggaaggaaggaaggaaggtaggacagtggggaaggaaggaaggaagggagggagggagggagggagggagggagggaggagagggagggagggaagagagggagggatggaggaaggaagtagggaagggagtgagagatggatggatggaaggacagaaggaaggagagaaggagaaaggaaggagaaagggagggaaggagggagtgagggagggaaggagggagggagggagagagggaaggagggaaggagggatagagggaaggagagagggagggaggaaggaaagatggctggcttaggtccttgaagacactgtgaagctgctataccattccaagctctcctatcatcaacgtgagagaaaaataaatttcattttgtttaatgcacgattattttgacttttttcagttatatgtaggcagatctaatgtcaatgaatacagacctgccctcaagtagctcacagtcccgtagagaagatgaatatgcagcagacatatcatgatacaagtagaaggtggctaaagcattgaacaaaactaaaaaaaagagctcgattcatcctccgtggcctccacggtaatgaccctgacagcaaaatccacaggccagggcatgctctctgtgtaatggcaatggataagctgtctgttctgaaagacgaatgcatccatttcaattagatgtgcccagtgctacgattgtaaccaattaatcctgcccatctgaaggctgattagtcggaatatttgggtgaatggataataacaggctaataagcctgctatccaaatgctgccacacgtcttttttgacacaatattgtggatgcatttgcagcatctgtgactaatcttcaagtggcgggaggcccagtttgcaaagcggcacagggacagggctcagggctgctggagtctcagcagacagagcctactccatctagtcctcaattgtgtgtttggatccaggcacccagactcttcctctaatgacatccttctgcttcctgaaaggtggagacccacattgcaggcacggaggctgggtgcagggccaggaggcagaaggtctcagtttcaggtttcaggcacaccctgaatgcactgggtgattcaatcatgtctctttccctctatagttttttaatttcctcatttgtactactcaccataatcccgaaacagtcttacttctgccccctggtatctgctcaccatctccttgcctagtacattctttcccactactctttgcctagctaattccttcccattctttaggtctctgctctttaggtcctattctttaggtctctgctgccttctggaaaccttctccagccactctttgcctaggtctctgggctacatagaatcctgtgtttcatgtattttaatgaatattgcatgagtatttactagtccacttcccccattcaactccaagcttcatgatgacaaagaccacgtctacttgcttacaactatgtccctgatgcgtggcatagtgcatggcacagacaagacaaaataacatgttttctaaagccttgttctccccatttcactgaactaagaggcaaaaggaatctggaattgaaaacaaacaaaaaaaagccttgcaaacctctaaattgatacacaaatgtgaggaattaggagtaatgaaaaagtccttgaaggtacagaaagaagcaattcaattcttgcaagagattcacacttgctcaatgtgtcaccaataattactctagcttttccttccctcatttgttgtaattaagacatagtgttttcattaggggagaaaccaaggcctagagcaacagaaattatgcacagtgcaaatcctggcaccatggcaaactagttgtgtggacgaggagaagccatgcaactccgctgagtctcagtgtcctctctgtacaatggaatgaaaatctccactgcagagctcataggtggctgtgagaatcaaacagttaatgtgtataaaatgacttgtaatttgtaaaatgctgtaaaattgtccattcaataacttcctgctggcatctctcccaaaaagacagtggaactcggatttcccatccctaaattctggggaagaggacagaggttaaaggagagtatggggtgtctgatgcatttcttcacttaattcactaaatatttactgagcatctagggggtacaaggtgctgtgccagaaaataggaaacaagaggtaaataaagtgtgcccttatttcaaagtccttctagtctggaggttagggggtgaaatgggcaagcaggtgaaccagtaatcaccaaaggacagggtgtatctgcaaaactatgagctcctagaatggagggatggtggataccagccctggggtgattattcagacctgacccagaagcaacatctggaatagttgaaggtccatggattctatcttgtgagggattttgaacagaaaagcaactagtttcaatttaccagttgaaaaaagattctggaggcaggcaaggagccaaaagcactgaggagggagatcacggcaggcagctaagtggagtctatccagaattttgtagagaagaatggaaaaagaaaaatcataacagaacaagagagaaaagtaagagggactcaggaaagaatattaattgaaagtgtgaggaaagaatgtctaataagaaacttgtaaagataaagacaaaagaagccaggattagcggcttgcctccttaacttagggtcttttgaggctatctgctgccaataccatttgtcacccaggctgccctcctggcagtagaacagaaacctgtctaaagcagccccatcattgatgaagtccccaggaatgggagacagctcagacatggattctgattctgggagtggtgtgtccccactgagtagcctctctcatctgcagttccttcatttgtaataagagggcagcaacacccacttcacaggagcaagagtcttgagtatgggatgatttgtcccaaatacagtcctcgaataaaacttagtttctgctgtattgagaataaaattaaaaacaaaaacaaaaacaaaaactgtcatccagcaccagcagctccttcctcacagtggaggctgcaatgtggtgacaggcccacagcccacacctctaagaggttcatcctgagatctggctctgcttcccttctggaaagaaacaaaatgcttcatttctgaagatggaggagagggagaaggctgtgtcagctccttttcctagaggtgctgggcacctggcacatggcactggggtgcagcaggtgcttgcaagacatgactcatatatgtgcctgttagtagtgacaatccctttattggtatgaagcatggctcatgaagccctttaacacgctgtgtctcattagtacctctcagcgacccctgcacagtgatctttttattcttagcctccaacagacaatgaaaatgaggcccagaggtaatcaggtgtattcacagacactatggtgtgaaagtctatttaccgaacactgtcatgtgtcagtcaacgccccagcctctggcagaagaatgagatatagtctctgatctcaaaacatttcccatcctgtagagctatagacaggaggaagggtaccttgtctacatcaagtgaagtgttatggtggaaggaagcttcgaatggtgagtacacacttaggatgcttatgaaattcaaatagcaaggacaaaggccatagtggattcttggagaagctgaaatgtgagttgagtcaacagtagctacttgcttaagtggaatcgaataaaaagaggagtgacagctccagttagaggaaatagaatgaggaaagaccttccagtgaaaacatcatgaagtatcttccatgctacgcaaagttcacaatgtctagtgcatacaatataaggctgggagtggcagaattgcattgtttggatcctagagagacttacaagtgaggccatggagttaggtcaatccttaagggaatggaaaccatggtaactttccaaatgtgtgctcagtgactaggctggaaccgcaatactgttggacaatgacaagacaggtctatgtcagtggcacctttctagagacagaagcaaagtctgtagtttctgcacagtttgtgctatcatgtgtttgatcaaaaagcagaagggtggcatatagtgcaaaccccaaacaccccatctggaaaaggtaaaggacatgtaggagatggtgccaatcatctacttttaaatacaaggtcagaaactctcatgccctttgtgcaacacccagtgttgtgtttctcagacttcatcaaggctggatggactatcgggctgcctcactgctgatgatgaggttcggggcaagtctcttcactctccaggcctcaatttccacatatgtacaatgggatgattgagccagtggctctttgtgctcgcttctacctttggcatgtgacaagtcttgctttctaataaatttttcagtgagtatttaaaacacctgttctcctgagcaactcctgtaagtcacatttgcaagggaaggaaagaacatagctgtggcttgataacccataactgctgaagtcgtatgaagttcttcaagtagctacttggagagaagaagaaagaaaaacaaggcaataaaccctaatggaaaagaaggaaaagaaaaggatccacgggaaatctgttctccccagtcttaaatctcaaagtcacggtgaatgctggcagcatctctctgtcctttctgtttaatctcacatcttcctccctgcaacctgtcctctttccttcctcaattgagtacttaaaagtgaaggctttattttcactctgattctcctttcacagattgtgcaaactggaaaaccatttaagatcattttgcccagaggttttcaaactttattttgtagcagaaccctttgttcaaatgaaattttacactcaaaggccaacatataaaatttataaaaggaaagttcctctaagcatgacgatcgaaggccatgcatgtggttcctctcttcacccaccaccttccccctggtcttgaggcacccccacagatccctcaggtcccaaggagcatgacatgaaaaccactgacattgtcttttttttttttaactttaaagatggagaggctgaaatccagatttaagagggcacttattcaagccgtattactggaagtcaacagagttggagccagaattcaggtctctggggtcccagggtaacacctatgcccttatcctgttgccttctttgtcccaatctgttgagacctcagtctcaagggccttctaagtggcattctccccagaaaatgtcaccgcctactcatctcctctctccctttctttagaaactcactaaccgcccactctgagtgctagttctgctgtttggaagcacatgtatcagcttcacctgatgtggcagacatattctctaagcctggggcttttccattgcccactgcccccgcagggacttcttaatccaggtggaatcagaaggcttcttatgaatttcatttcatttcaacacacacacccacacacccacacccatagtctttagtgatgcagacataggaactggcagaaccagcaatgaatgtgctaggcatcagaagactgggtttgagtgctggtccaattcttttcaacctctttgatcctgttagacacatttctttgcccattgaggcccctgccctcctacttcacaagttagtgttgaagatcaaataagataatgaagacagaaggactgataacctataaagtagtttatacatgtaaggaatgattttctttggtaaatttctcatcatttcccttgggcaggataatttttatcagttaatccctaaaacctatttccaattatctgttaatttattaatggatagttttagaaaaatatttttctaaccattatttgatcttgccttctaccaaaaccattcatttattaattcattaattccataaacaccaatgaagcacctactattaggttggtacaaaagtaatcatggcttttgccatgactttaatggcaaaaaacagcaattacttttgcaccaacctaatatttgccaaaacactggctccattggtctcataaagtccaaggtctcatgagaaacacagatactgtcattcctgtggacagtgcttcaaatggggaaacacagactgagagaagcatatgggagtgtgtactctagcctggggtgaaaggtccccaagggcttctaggaggaagtaatatctctgctaatatctgaaggttgagttggagtgatctgatgaagtgggtgaggataagacaggaaaaccctgagtcacccagaagaagggaagagcaggtggaacaaggctgcaagtagttcagaagggctgaagcagggagggcgtggccacaggtgaggctgaatcaagaacaagaaggagtgggagcgcaaatggttctatgagtgaagctgaggagtcagcactatgacagcatcctcgctttgcagaggagaagctgagaaccacagagatgaagttacttgctcaaggtcacaaatggaaagcaacagagatggaaggtcaatcctcagctctgtccctctgcctggagccctctactcagatacctctgtggcttgttcacttccttataccattcataacttcaaacaaatgctattttttttttttaggtaatgctttgtgcgacaccctttaaaaaaatagaaccacctgtcattctctatcccattaccctacttcatttttgtctcatgatacttattataaatatggtaatttaatataatataaatttatctatttgtgctttgtcctcttctttgaaaaaaacataagcttcatgaggacaggaatttcattctattcatgttgtctacctggtgattataacagcactgagcacatggcaggaactcaataaacactaaatgaatatgtacctgaataaatgaatttcaacctatctaaagcccttgctatgatactcaagttatatttctgtgagtgatggggagtttctaatcttttagctgctattagcaggagaataacatgatagaatctggctttagaaagttcacactggtagcattgtgaatgatgaatcagagagaggcaaacctggaggccaggacagtgaaaggcatcagtactaattcttgccagggaagatgatagtgtaagattgtctacactaggtagtcataagagggatggagaagagagtcttctaaaaagcctgaagcctcaggcagactatcagcacaggaattgggagctcactaagagaagaggtcataaaaggaaaaacacatctccaaggaggcaaaactgttctcatttctaaatattatgcccaaaagtggctagaatagtctgtcaaattaaattccttcagaacaacctctgataaaattatattctctataggttggagaagaggtgtctttggaagacgataaaggagatttttgcattgcctaataatgatggggatgaatgtcttaatcaaatggagatcaaggccaggctcatttgataaagaggccagtttctctgagaagatagagcctgagcaccaagggacagtaggatgcccccgaaagtgaattcttcctccttgctttgtgcatatgcatgcttatctgtggccagaactctggaggcaaaactaaaaggtggtggtttctgttctgacaaagcctggacagaaactaagaagatgctgcaagtaactaatttgattgcatccattcatttccctcgttcattcatttaatcaaccagtccaccagggggtcttcagctaatacttgctgatattctcaaagtgccagacacgcactaccaccaaggacagagcaagaaacaggacagatccaggctctgtccacatggtgctaatggcccagtgtctcccaactatgttctttgcacaaggtcattaaattaaaaaaacaaatcgttatgttgttagagtgttttatatttgccagggactagatatgtcttgtactatttaatcagcaattctatgaggcagttatcatcaccctcatttgtcaaataaagaagctgaagctcagtgaggtttaggaatttgcagaatgatgcagcctgagatgtgggaacatgtatttaaacccacgtcaagattttgccaaagccctttttccattctctgcagcctcttacctttgcagaaattgggctccaaagtcagataaccttggagtgaatcctggcttcacaagaatgtgcacttcagatggtgcctggctctcagtaagtgctatactatgttatatgttgttgttgctgttattactaattaggcaagctcttcatctcagagtcatagcatcctctgtgaaatgggaccactaatgcattatggaattttgatgagaattatgaagatttaaatagatgatgtagattgtgtccattttcctgtctgatatattgggcagtcattggtggcaaggtcagagcccctggtcataccatgactgagaggcatgactgcatctctggaggcctggtcccaggagagatcccttgataaggcttttcttcctctccacacctgggtccatttgttcaaaggggctacagtgatctcccagatctgttcttatatctcttgtttctcttcagcatggggagtaaagcagaggagcaaaggaggtgctgggtcatgaggccaagaatagcaatgccctctggaatgccctgaggcaaacagagctccaggctagggaccaatcccagagacatttccttggccaccaccaaggctgtcttcctcctactggaaagcttccccaagataaaaaacgagctggtatggcaggaatccagcaactctagtggagctggacattgtgacaaaagcaagggagggacatccatttagtgaggactttctgtgccgggcctttgcctccttctttgcctgtccccaccattcttattctcatcacatctctaaaacaagcagggattacctgctccatttaagaacaaggaaatggaagccagagaattacagcagttgccggcagtcgctgtccctctgaccaggcaatatctgatggtgtcaaagcatccatgaaacaggagctggggcagaattgtggggaggatgggcctacgataacctcttgtcctagaatgaagctgaggtcagcctcaggactactggcctcggaaatgcagtagcctgagcagctcctatgccttatttcttccaccccattttggccacacacccagaggttcttatctgcatgaagtgccagcaccaggaagcctttctgagtctgaacgctcacaggcctgcctacctccccagccctgaacagcatcccgacaggctgggagagcttggaactctggagtctggcaggggaggtgaaggtgaaggttccaacgccagctttgcttttactgagatttacttccttgggcaaatgactccaactatgcgagcctcagatttttccatctgtcaaatggggccaataataggtaccatagaatgatggtatgagaaataaatgataagatgtattgaagcacatggtgagcattcactaaatgatggtcatagagtcaaaatgataaaggctatcatttattgaggatttactacctgccagacccagttctaaatgtttgtgtagtgattaatatccttaagtagcatttatcattattattgatacattttcttaaattcaacatacgtttcatctaccacacttctgtaaagactactacaacccaacccagggtttccttggcaatttgatttgaccaacagctcctgagcacctctgaagggtgagacccagggttagacaatggtgagacacaaatggggatcgtttatggtttctgctgtgggtaggaagcttagtgtcaacttaagcaataaaacaggggcacagttgactaccataacataaagcagtggcatttaaattatgtcccattggggcccacaataataaatacagacagttgtatatatgtgtatatatgtatgtaattaactaaaattttttcacatcaaaaaatactagatgtgagtcaaggtgttccattctggtttattctattttggtacattctgttccattccactctattccatatcactgtctattctgttcgattacacattttattctattcagtcctttctgttcctttccattccattctattttttatgccctcttctatttttcttaaaaaggcttgctgtgagccagtaaatatttcaggacttattaaattgtttcaacccatctttcaaaaagtactgatataaagaagctgttttccagttagttgcagcgaagaacatctaaattaaatcctacctaatcctagtatatgaaacacaaataatcacagttcttctggctgaagaggtgttgggggtccagaaccaactgtttggtgacttattccattctgggcatccagaaatcagtgaggactatttagagttgacattaattataaacagccccctctggacttccagagagagtgcttcagagaaaggatggaagggagatcatttaaatttgtaatgcattctgtatatttatcggatgcctactgtatgtcaggtcttgaactagggctgagatacggcagcaaacaagatgcatttcaccctcattaaggggatactgaatgcctaccatgtgctaaagcaccttacacacagaagcacttttaacccacactgttcccttgggagattatttgtgttacacccattttacagataaagaaacaggctcacaaatagcctaaggtcatacattgatgaatgttagagctgtgatgtaaacttgggttgattaaactgcaggttctttacttctaactgggacaatattcgaaaggctcagagaggaggtggtttctgagatgaatctacctgtagaggtgaaggagagtcttccccccatccctcaagaaacagaatggtgtgagaaaagtacagaaagaagattgaggatgaaacaaatgccgggagaacacggaggagacatatttggctggaacacagaatgtatgacaaagagaattgcaatggctattgcaagcgatgcagaacacagggaggggaggaggaagaaggctcagctctctctagagaagctttctagaagccaccggggcaagtaccacaatgaagggcatgttggacaggtctctgttggaaatggagcatcaacttcaatgtggaaaggtacaacttatggcaggaaaacttacttctttgaaagcacacatctagagataatcatctatccaagggaaaagcaaatttggtctgaatgaaaatgatgtccacaagaataaaatcctttcacttggatcactaacaaaacactgcctcgttttcaatgcatttgaggctcacaccaagcctgcaagtttggcagggcagagatgactgttttctctgtttgatgatgcggaatggggagtgggaaggagttgcagagctcaactcatgttcagcctcacccaggactcgccttataccctgtgcttcctcctcctatgctttccagagaacctgctcctcttttgttcagaggctgctgggaaagtagggtagcacatacactaaatgctggaatcctggggcatctgcagctggtgcagtcctcagaaatgccactctgagggtggacagagaataaagggacctagtgtttatcagattttactatatctcacacatattggataatgcttcctatcatggaacgttatcattggttaggcactaaggttcccatcttaaaggtaaagcaagtgaggcttagagagattaaaacagttgccaagatcatacaatcaatgactagaagaggctggacttgaacttaggtttgtttataagcccatgttcatttcaccatatcatgatgtcccttgatgtaagatcaaataatggaaaatctagactacgttatagtagcataaataagaatacggaaaagggaaagaagaagaaataaaggaggaaaaagagaaattattaccattctttatcccatgactactacaattcccctactactattataactcagaccctctcaccttctaaattagtttttcattcaacagcatatttgattctcacaagaatgctgcaaaggacagaggacccactattttctatgcatttaagagatggggaaactgaagttcagagaggttaagaaattgttaaagacacagatagtcagttaaaaacctggaataaaatttgatccaaaagatgtttagctggaaaaaaaaaaggagacagaagaagacttggaatatttgaaagcattctttgaaatatttttgtagcacaacttatagaaaaaaacctccacatttttctatgggactcagtgcacatacacacaaagatacacaagcatcaaacgtttcagaaacaaacttgtccttactttctctattttgttctattctatttccatttgattttgatgaagaaaatgctggtcctgattcattaaatggatttactatcttactaatgggtctaaaaggactagagtttggggaacagggacacactgacttcggggctgcatgaaagctagcttaaaggatccaaagaactccaacatggaaggaaaagtagattcatgatccagcgctagagatgacacaactatgaccaaagagtagaaactgtgaacacagattttaggtcaatctggagaggtctttctaaataggcaaatctgttcaaaaatagaaagattgccctgtgaagtggtgagctccctggcactagagccatgcaagctgaagcttaaagatctcttgacagggctgctgtagaagaaattgaaggtgacctctaggtttctttctaggccagaaacattatttaatgtatttttctcattttctccccaggacagcagccaccacagaaaattttggctttgaagtgagaatcagaggacacagaggaaaaatagagatgctgaatgttggttccactgtcaagctggggaaatgatatatacctctctccattcccacaacataggagaaatgaggggcaaaacagcattccaggagtggactaaatgtataaaagaagagcaaaggaaatcggagaaaagaagagatttgttgtagtcattgctctgccctcttttccattgtgggacaaagggccagcctcagttttcccacctatacagtggggatactgttggactacatctgcaaggatgatttcagttttcaggttataggtttttttgttgttgttttattcctgggtccccttgtcactgctcaagatgccagcttggcagctgaggccagtaaaaagaagagtagggagtggtttagtctctccattggaaggaagaaggaaggaacgattgtggcccatctctatagccttgtgctgacttagagtgtctcatcccatcaaacgcatgggtcatgaagttcaattcattaattttggtggtggagggaggctgacagacttggtgctgacatgaataatgatgggtcaccgggagaggccccagcaaaacctgcagcttaatcagactcagagagtctctgcgggcattaatgtaggccaagtgctttccagccaatcagaccccatttcaatttaatgttgcaaattgttaccacgcagctcagcctctcaacgcacaactcagactcaaaagtgggttactcatctgttcccttttcctgttcatttggaaacacctccctgattattgtctgtgtgacagtttgcagcaaaggaggtggataaagtatggtggcaagaattcacaccgggttatgtaaggggagcgggtgtccctgctccatcactttctattcacatttctaaagccatgctttgcttgcttgtaaaggtctgctgtgtctccatcgcctgcaggataaaatccaagcctttatcatcaaaattctttagccttaccacccacagtgcttccccaggcattctctgccacagccacaacaaaccacttccactccctaaaacatgctgtgcccttgcatcttgaagcctccttgtgcttgcatatgttgtgccctctgtctgaaacgtctgccttagctcccctctgttttctctgcctcacctgtattttccagtgtcaccccagaaaaagacacaccaaagtagtagatcctgaagggatagggatcgtctatttcacttcttgcctagagtagatatacaaaggtagaataaatgaatgaaagaatcagtatataactttggccaagacatttcaagtttctgactcttctttttcttagatacaaaataataaaaatagctctttcacagatattattgtggccagtgacggaaggcttttcagcccttccaccctcccagtacctctgagagccttctttggatgaaattgtccatgtaagctcctgacctcaaaaatgctccccttagctcctggggcttcacctctctgtagctcaggtttctcagatgcaaaatgtgtgtactgaagcatgaatggttggaaagattaaaagcatgtattcactcatccctgctttcagtatatacaaccaatgtataagccaaaaataaaattctaaggcccccctcaaccatctgaatggacccctcctctcggccaagggcatttcaaagttaacctgaaaaactagttcaggccatgatgggaaggggaggtcagacatacctcattatgccctcctccctttgggaatttgggaaaaaccaaccagcattaacatcagcacagaccatagatctaataagaaacgtatacaatctgttttctctgaagcctgctacctagaggcttcatctgcattataaaaccttggtcatcataacccagacattcttttctattaataataactctttcaaccaattgccaatcagaacattttaaaatctacctatggcctagaagtccctgctttgagttgttctgcccttccagatcaaaccaatgtacatcttacatgtattgattgatgtattatgtctccctaaaatgtataaaagcaaactgtaccctgaccacttcggacacctgttgttaggaacccctgaggctgtgtcacaggcatgtccttaacctaggcaaaataaagattctaaattgattgagacctgtctcaagtactttgaggttcacagatgcaaattattaaaatgatgactgtgaaagtgactttaacagaataaggtacagagtaaatgctcaataaaagctttctacctctttaaaaatctcatatccttttttacttcctgtccttctttcttcttgctttcctttcttttatcccttactggccctgtcatctccctttttccccaaggtgtgattttggaattctcatgggcttggggagaggggatcaggtacagcctaacgttgcccctaaaaaccctgacacaacatcaaagctagccacccctttaacagagcacatgaatgcaatgcactaagaccacaatggcttcaccttcaccaactgctatatatactggactttgagttcctttgagcaatctgtcatgtgaacagagggcaaaagggttattattaattaagggaactgggaaccactgttattcttcttctaaaggtctaccatcaaaagtacatctcaccgttccactctatcctggataaataagtgccaagattgaggcaaggtctgaagcaatgtggtttcagttcccgtcctcacttcctggtaacaaacttcatgtgctttagtgcatacataaatcccctaaaacttatcaaaaaccatatacaatcaagaatcgacaacctaccagctgtcaacaacagcaatggtgttgagaaaaatcaaaaggtcagaaattgtgatttctttatgtggtctttgaatgtagtcaccaagatgggaaagctgaaaggtccagatagttatactgtgtagggagtggtaagggagaagtcacatctccttactattaactaactgtgtgacctggagccatctatttctctctgaactttagctttctctgttgtggaatgagtctggttcagtttaacaaaacccaataggcacataccatgtacctcccaggcatgaagctaggcacagacacattgacaaataatatatagcttaaattgacggggaagactgaatttgaaagtactccatacaactgaaaagtatgctacacaaatactccataactcttttgtgaaagtgtgtataagtatgtatctgtttatgtaaacatgaattattccagtgaataaattgtaaagtgaagacattatgctcagtacatgtatctgatataaattaatcaatagtcttgcatgaatgagatgttattagaataacactaaagacagagcagtgagcacaatgaattccctgctttcatgaagatcacatggtagtaataagaaagtcacatttgaggggatgaaagacaacagaagatccctgggcattttcactcagttttggcagcataattagtgggaaacctttgtttacaaatagagactaggcaagttgagggtgtgtaattcagcagaaattgggccaagaagtaggatgaccatgtgctgattcaggacctgacagcaccatgcctagtaaatgctttaggtgttgcataggcagcagatctgttcaatctgacctggatttaaataagtttacacagcttcaaagcacttggaacgtctgattccactttcatggctatgcttgaattcaccaggtgttatctctatcagcaaatgtttcttcaataaatgcccagccaagcctcctgcttgaacactgaagtctgaaacaaaagaatgttgaactccaaagtctgaaaaaaattaatatcacaccatttctcttaaaatgtctcccatgactctctcctcattcttacctctgctttctatctcctccaccatctgtagccctaaactgtgcatttgactggaaatgtatcactcaaggcacctgtggtggagtgaaattggttaggatttcatggtcccatccaatttcagctagcagcaggcaaggaggggaaatattcagttatgagcagtctcataccttttgcttttctcaaagcaaagtttgggaagaaggatcttttactgttgttgtttccactagagaactttgtccctttggaattattttgccaaagactgtgatagaatctattaagaagcatctttaaaactatacttattgggcaaggaagataatactctttattttaaaaaggtattatttcaattctctttctttctttttatcagcattatcctaatggcctctatcatttaggaatcagagaacgacataaacaaaagagtaaatctgagcctagtaatttccaggacttcacccaggaatagaggataaaatttataccattagcagggatcatcaattttttttggtggtaccagagtgtgggtatacgggagaaaggaggaggccacaccattaccatcacatgatcaagactgcaatttgtttttcctgtggttaggcagagccataagatacggtactcaaatgtaaggatatggaaaaacactttgtggttattaatttcatctcctacctaatactgaatattcccacccaacactgtggttgatattctgtttctttttttatttatttatttatttattttttatctccttagcatcctttccctcttcatttttaataaagacctagttttcctttgagaaactaaatgataccccttcaacaccctcaatccatgtagtctagatctggctggcctgagtctcagttcaggagtggccacctaacccagagttggccaactggagcattgcagtgaactttttagggtttgtattaacagcaggaaggataataacccccaaagatgtccaagtctttatactcagaacctgtgaatatgataggttacacggtgagggagaattaaggttgcagatggaattcaagttgcaaatcagctgatcttatcatgagagattatcctggattatcaagaaggacctaatgtaatcatagggtcctagtaaataaaagaggggcgcagaagagaaggtgggagtgttgtggtgtgagaagaactcgaccccctagtattggctttgcagatggaggaagggggccatgagccaaggaatatgagtggcttccagaagctggaaagggcaggaaatcatattctcccctaaagtctctaaagggatcacattgttgctgacaccttggttttaacccagtgaaacccattttaaatttctaaactacagaactgtaagatactaaatctgtgttgtttcaagcctctaaatttgtaaaactttacagcaatagaaaactactgcaggcatggacacatgagcaaattatagttcgcccagatactttggctaaaaataagaaggactcctttttttctctctttttccctaatgatactaaatataaagtaatcttatgaccgggagagattttgcccaaaaatgaaacctacccagaggaaaccagagtgaagtataactttgtgtgaacatttttatctaactattcctgaaattaaaagtagatatttcagtttctgggagaaataaaggccttatttgtcctttagccagtttgagttggatttatatcacctgcaaattctttaaaaaaatcctaccactggcatggtggaataaataccatttcttgaaatatcttattccaatgctggatacttttgctattatttcttttaaaaatagaactggaattggctatcgtatagcttcagtcattgattcttacgtcctgaggccacacaggacaattttaactcctatttcaccttgggagatactcgggaattgaagtagtgatcctcatcaagatcctcaaatcttcacttctccaggttaaatcctctcagttttttccagaattgtggtaatatggttttgaaccttttcactaccctgtggttaatcttccctggacacacttgatgttcacaacgtttttcttaaagataacactacaactgagcacagtattcaatgtagtgactattcaaatcagaacatcctgtcctcggtgggacacgtttattgatgaaatctaaattgaggctaggcacagtggctcatgcctggaatcccagcacattgggaggctgagacaggtggatcacttcagccctggagttcgagaccagcctgggcaacgcagcgaaatcccatctctaccaaagatacaaaaattagccaggcttatgacctggtctcaaaataaataaataaatatttaaaaataaaattaaaaaaagaaatctaaattgaaaaaaatacagtttatttatggtatccacataatactgttacttcacttagtttcttgtccagtaaaatctacaatttttttttctaggtgatactgagttatttctctggtccaatctctacatttaccccattcgtaaaaattatgtcttgatgtacatagagatctttagagttacatctactgaatttcattgcaaagagaagtggatagtgagtaaaatacaggatttgtattcagacaagtctggattcaaattctggctctaccactcatggctgcctgatgttgggcaactgcataatttctccaaatattagcttcctcgtgataaattactgtgccttcctcataccactgttatagaaataaataacataatgcatggaaaatgcttggtgtagtgcctggcatgtactaagctaccgaatatagcaccggttttatattcaatcagaaaaataaataggtcagagctttcaatcttacttccgaatatacaagaggaaaagttagggtgagagaggaataacaaaagagaaggagggagaaaataaaaacacaactggtcttccccatattctcggcttacatccaaagtcaaacacagctagtcttagaaaacaagatatccaaacttacttaatactggaagtgttaggcttaacgtttttgtttgcttgtttgcttttgaaaatgggacctggtaggtgggaagtaaaaacgttcccttagaacaaattagataaatacaaagaaatcacacacatagtggaggaatgaagatgtttgtaagttgatatttcggaaccaaacttcaggaaggaccttggcaacatctaagctgagatgttttcctcctataagtaagaaatgtaggctcagagaatgaaagcttttttctctgtttcaactagaaaatctcacagctagaagaagtcaaggtcatttttccccttctgagcccaaaatccctggtcaaaggggccatagaagaagtctatttaagtttgtctttctccagaagcagttcagaagataggaatttgactgtaagtggcttacttggaaagtgatttcagaaataactattagaggagttaggaaacaaggcagggaagaaaaagaaggccataaagaatagtttataaagccagatgccactgtgggcaacagaaggtgcattgtgctggggcattctgagaacaacagaaatgcctcggagatagcccactggagtggcaagggaggtgaggcatctgttaaccaactcccaacaatcagcagttaaggactgtgcttgaaggtccagtgattcccggcactgcagccttccccaggcatgggcagaggggtaccgagctgccaaagaacctctagccaaagagtcacatgtgctggcaactgaaagtcaagccagcattcatggagagggtcagtgttgagggcatgtgggctggacaccaagagtgtctgctataaaatccaagtggaaatgagacagaatctccaatccggcctaaatctgccaaccagcaatcaacaaactcaccaaccaattaagaaataattacagctactagctgtgctgatattctaatatgttaaagatacagaaagaacattcaagtgctttatcactccactgatgcaagtagtcacatcactacacaatggttcctcagaatcagaaaaaattgaaagcaaaatggtaaaaaaaaaaaaaaatctcctaatattttagtggataagaggtgggattatcgaatacccttaggccataaagaatagtttataaagccagatgccatgttaactcttgaatgctaattcctttctggaatatttcctataaaacttaatccttcaggaaccatctaaaaggccatctcttccataagatttgctctagtggtaaaatgagctaatctgctaggcttaactccctgtgacctacccagatccctaggttgtgccagacagatgcagtttatacacattcctgcacttcctcatccttgagcttcaaatcagacaggttttataattaagatattgtagaacctcactaaggattcaagctgctctaaatgactgcccaaagctaagggcacagccaagggaaacatctataactccctccctccctaaatgccatgggatccagtaataagcacgcctacaaagcaaaaaggaagcacacatgcaacagaaactcacaaacacacacacacaaaaacatacaaacaatctggttacaaaatatatcttcaccagcttctacaactagttgtattttaagatgaaatatgaaaaaaaaaattggcaagttaggtgttactgctccatgctgaccttttcctagtagagttaaaagagccaccatcaacattagaatgcgaaggttactgacagtgccatggagatgccaacttgaaagtccccatctcagaaaaagaccagcaaggctgctgagcatggtacgtcccttttctcctagataactacactgacccatgtctaccacctgcaaaaaaataagttgcctttaataagtgtgcattttttctccttcctttcatattttttgtaattattattttcgttttgctttaaaaatcacttttctccactagggtaataaatcactgaagacaagatcaactgatgaataataaaattagtgggtataaactttttagagaaacaagatatttgtagagcctcaaattatctcccccaaatgcttgttaattgctttagtggtctcaacaaatgttcacaaattatttgaagctttccttctaggaggtggatcttaatccccctcttcttgagcgtatgctggatttagtaatttgtttctaaataatagagtgtggaaagagagaaacagtaacttgagagtggagaaacctggcagccaccaccttgtacaagtcatcaagtacataattagtcggttgataccatgtaccaggatggaatgagaagagcacttcatctttgtggcattctttgtccaaatctggagaccctaaactaattccaaaaataaaaataaaaatcagacaaacccatatggagggacatcctacaaaatacctgaccagtgatcttcaaaggtgtcatgatattaaacaaagaaaggctgaggaggaggagaccatggagacatgagagctaaatatggtatcctggattggatcctagtacagtaaaagggcatcagtggagaaactggggaaataatagcaaggtctttagttaatagtgttgcaccctgggatcacttggtttaatctcatcacattagagacaggggaaagctcagaaagaagagacttgaccacagacactcagcagttcatttcttgttaatatctcagtacatacacatatactatgtttatgaaagatattaacactaggggaggctaggtaaagagtatttgggaattctctgtgccatctttgcaaagtttctgcaaatctaaaattatttccaagtaaaaaatcttaaaaaatgcaaaaacaaataaacatcaacaaaaaaattcctcctcccaatggtgtggttacaagccttggaatggggcacctaagagctggctcctgacttcagctcactctctgactttgttgatacctttgcctctcagggcgcagtttctccaacagtttcatgatgtttcatgatgaggggaggagcggggagtgatttagtagttttcaagccatgttccccagggcacagctttgatggtatgtggggtgaactgagaaactgaagtcctgctcctgcaactcctccgaacctccagccagagcagacccactttgttgttacatatcaggtgtctatgtggacataaacaatgccaatcattgcatttcatttgatgaatgtgtttcatttgataaatagtttctgctgtaaaatgttaaaaagcactggaatagattataaatgtggttcccttctaaacttactttcattaccaccctgccaagtctttcctgaattaactgagaatgacttaaacacactgttattttcctctttccctctcttgtccattagctttctgtgggtaaaagccatgtatgtccacctgcgttcatcagtccccagcccttgtcatgaaacagtggtcgatatcaggtgaattaatgttggatggaattcctggagtcaaataacctcttggaaaataagagggtatgggataaatccctgaccccagggacttaccagcatcatcttctgggaaaaagatcttaactaagagggagcagttgtaaattattgactgaagttcaaatccaaggcctgaaccaacgttttcttcctccaggaggctttccttaatcactctggctagaagtatactttttctcctctgtgttcccaccgtctaaggtctgtgcttctgatacagtgccatcttgtattccctgaatacatgactcaggaccctgacccaaaagtatgaaaaccttcatctgggaataaagattaagtgcttaacacaagaccttgtgcatataagatgttccagaaggttgaagaagcaaatgaacaagctccaggtcccttgtttcaagcgggtcaaaacaaagctctgacagatcggggtttgaaatctaactctgccagttcctacaatgtgacattagacaagctgtaatgtctctggggccccagtctcaagtctgtcactctagttaatactgctaataaactctgttgaccaaatcacaattccaggggtctaacaaaaaacttgacacatgctgagcgggttgttcaagaaatattagttgaataactaaattgtgacctttcagcttccttacccgtaaaatagcaatacgaatacctacttcgcatggctgtggtgaattaagtagcagagcataagacaagcaatcagcacaatgcctagtgcatgacaatggctcaataaatgtttgtttttcttctagtcttttcccatcaggtattctcgccagtgaggggactgacttaagtacttctcccagccatgtgtttcattatggaggccaaattaagaatccaaggtgcttacatttcagcaaaagacgctagaccacggagtgtggcatggggtgtaatgtattcacagtagctatgctaagaaaacatctaggcccccagttgagagactatggcagcatcattagcataacaggtgcctttgctagaagaatgacactttaaagacaaatttcccccaatgcatttccccaaacgcaagagtgcatatttaattacacttaatgccatcttctcctctatttctgcgcttgaaggggacacatcaccccacaaaattggggaggttttttatagaaatggctaggatccagaactgcttcttagctccagggcccaaaggaaaaatgtcaacaatggtgcttcggggaaggaaacatgggccttatttgtttgcttgaagaacatccagctgagacagaaaatgatggaaagagcagaacacactgggacctacgagagctgaggttcagcgtgggcaaggccccgtgcgaatcatcatcacagattatttttaatgctcacagcaaacaaaatggtgtaagtctagccatcattctaatttgcatacaaggaaactgaggtttagcagatatgaatagtttttccaaggttgcatagctagtgattgaggcacttaaagttgaaccaaggcccatgatttttttcctctttatctactgtcccaatggtttcacttttggggcacatactctgcaagaggcactgtgccacaaatttcatatacatcttatctcactgaatccacatgcccattggatagtatttttcctattttacagaaaagaaagccgtggctcaaaaagtgaattaatttgccctaaatcacaagtagaggtaataggaaatttgggatttaaacccaaatttgtccaccttttatcctcagtgtcacattactagctgtgcgagtttgaaggagtaaattttcatctctgggtattagtttttcttgtttaaaaaaatactttttatggtggtaagaaaacttaacatgagatcatgagatatactctctttacaaatgtttaaatgtacaacacataatagtttgctataggtgtaatgtggtgcagcagatccctataacttattcatcttgcttggctgaaactttatacctgttgggtaatagctgctcatttctccctccctctagtctctggaaatcaccactccactggttgatgttatgaatttaactacttgaggtatctcatataagtggaatcataaagtatttgtttttttgtgacaatgagggtcacagagacattaaatggcccttgtgcctctaacatgccacagtttcatgagtttctttgtcattaacttttccctatttgctaccacagggcattcctaacctttcaattatccccaagggatacccctgtacctggcataaggatgtttggtctcaccattgagtggctctgtgatcttggacatgataaacttttctaaacttcaatcttcccatctataaaacagagctaatactaatgacaaaagctacaatattaatacctaattgttttcaggataaaatgcaatagtaaatgtgtggatattttcttgaatctgccaaagcactgtacaaatattacctagcattattataactattatcacttaagtggaatgcattcttttaaaagtgattaacttttgtcaacatagagttgattcgtgaaagtataaatggtcctcattgacccatacatgaaaatccttgttttctaagatcttctcttcaaagcttctcactcagctttgaacagatactttcaaatggacactcacggcattttatcaggaagatgagaaaatgttattttagcatagcggctactagcacagacctgggattcccacatcctggacttgtatcagtccatttttatgctgctgataaagacacaccagagactgggaagaaaaggaggtttaatttgacttacagttccacatggctggggacacctcataatcatgatggagggtgaaaggctcttcttacgtggtggcagcaagagaaaatgaggaagaagaaaaagcagaaaccccaataaacccaccagatctcatgagacttattcactgtcatgagaataccatgggaaagaccagcacctatgattcgattacctccccttgggtgctcccacaacatgtgggaattctgggagatacaattcaagttgagatttgggtgggaacaaagccaaaccatatcattccgcccctgacccctccaaatctcatgtccttacatttcaaatccaatcatgccttccacagtccctcaaagtcttaaatcatttcagcgttaactcaaagtccacagtccaaagtctcatctgaaacaaggtaagtcccttccacctatgagcctgtaaaatcaaaagcaaggtagttacttcctagacacaatggggtacagatatcgggtaaacacggctgttccaaatgggagagattggccaaaacaaagaagttacagggcctatgcaagtctgaaatccagcagggcagtcaaattttaaagctccaaaatgatctcttttgactccagatctcaaatccaggtcacgctgatgcaagaggtaggttcccaacgtcttgggcagctccacccctgtggctttgcagggtatatcctccctcccagctgctttaatgggctgccattgagtgtctgcagcttttccaggtgcactgcacaagctgttgatggatcttccattctggggtctgaaggatggtggccctcttctcacagctatactaggcagtacccaagtagggatgctctgtgggggctccaaccccacgtttctcttccacactcccatagcagaggttctccatgagggccctgcccctgcagcaaacttttgcctgggcttcaaggcgtttccacacgtcttctgaaatctaggcagaggttcccaaacctcaattcttgccttctgtgcacctgcaggctaaacaccatgtggaagctgccaagccttggggcttcaaccctctaaagccacaggctgagctgtacattggcccctttcagccacgctggagaggctgggacacaggcaccaagtccctaggctgcacacagcacaaggaccctgggcccagcccacaaaccactgtttcctcctgggcctctgggcctgtgataggaggggctgctgtgaaggtctctggcatgtcctggagatgttttccccatggtcttggggattaacactaggctctttgctacttatgtgaatttctgcagccagcttgaatttctcttcaaaaaaatgggtttttcttttccactgcatcatcaggctgcaaattttctgaactgttatgctgtttcccttttaaagtggaatgcttttaacagcacccaagtcgccacttgaatgctttgctgcttagaaatttcttctaccagataccctaaatcatctctctcaagtcaaagttccacaaatctctagggcaagggcaaaatgctgccagtctcttcactaaaacataacaagagtcacctttgcaccagttcccaacaagttcctcatcaccatctgagaccacctcggcctggaccttattgttcatatcactatcagcagttttgtcaaagccattcaacaaatctctaggaagttccaaactttcccacattttactgtcttcttctcagccctccaactgttccaatctctgcctgttacccagttccaaagtcgcttccacattttcagttatcttttcagcaactcctcactctactggtaccaatttactgtatttttagtcctttttcacatcgctgataaagacatacctgaggctgggaagaaaaggaggtttaatttgacttacagttccacatggctggggatgtctcttaatcatggtggagggcaaaaggcacttcttacatggcagtggcaagagaaaatgaggaagaagcaaaagtagaaacccaataaatccaccagatcttgtgagacttattcactatcatgagaatagcatgagaaagatcaacccccatgattcaattacctccccttgggtccttcccacaacacatgggaattctggaagatacaattcaagttgagatttgggtaggaacacagccaaaccatatcagggctctagtctgagctccatccattctagtagaagagttttccctcctgaacctcagttttctcacaggtaaaggttagttaacaacagccttctcaatggagtgctgtagagattagataagggacgagtgtgtgaagtgtttagtgctattcttgggacataaaaaagactcaggatatggtattattaataacaaagttttactgatgcacaaacagcagcagccaaaaagacggggccatgcacatgagcacacagaagcagaacaggatggctcaggtgtccattttcattgcccattcctccatgccacctgctctaatatataccctttcacatggtgttaaaggatgaaaaacgcatttgcttaaaatccatctgctttttataacttccagagaccaaaatctgcacaagcagcagttctttgtggctcctaattaattcctaaacaaagactgctctggcagcagcccagtttatcaaaccaattgacctcctggtgcagaaatgatgacacagatgttgttgctatgtcacaacctcatttttcactttgcatcacttggtcaggccagacatatcttcaccttctgaggagtagaagatagtcccctgggtgactctgagaccctaattgttatctcccatggttatgggcctttctccactcaggcgcctcccaacaaaagtctggagtggaggtctggtgtggtagctcacgcctgtaatcccagcactttgggaggccaaggcagatggatcatgaagtcaggagatcgagaccatcctggctaacatggcgaaaccccgtctctactaaaaatacaaaaaaatagccggacgtggtgacatgtgcctgtaatcccagctactcaggaggctgaggcaggagaatcgcctgactctgggaggtagaggttgcagtgagccaagatcgcaccactgcactccagcctgagcaacagagcgagactccgtctcaaaaaaaaatagtctgggttggaacaggccagaaaacatcacctgtctttggttaatctgagggcttcccaagctaaggaatctctaatctgtagggttcttgggaggctaccagtaataataatcacagtggccatgaacccagtgtctattatgtgccaggcactctcctgtgcattgtgcctgctttatctcatttcattccacacaatctttgaagatatgagttagcatcttaaattcaaagtcaagaaaacagaatattggagatatgaagaaaggcttcacaacactggaggtgccatggcacttcgtataggtgagttaccaagaacttctttcaagttatctcatcaaggcctcactccatcactgtaaggttctgacaggttagacaactatttccaggtcatacaagtagtaggccaagaaatggtcttcaaaaggggtgggcctttcctctgagttagttgttcttccaattggattaggaactcactcttataaccccagataaccttattacctccttaaaggccatatctcctaatacagtcacgttaggggttgagcttcttaatcaatatgctaatgaagacagcatgggctcaaggctgaatctaggttttgggtggttgtgtgaccttgagcaatctcaggcttttcatccagaaaatgagtatattcttacacatttcatctgtgaataatcattaaccaccaaagttcttgccattgtatatcaaagactgcctttcctctattctccaatatcatcttcctcatttccatcagaaacctcaccacatgcacctttagcatccattttttctatcaacagtgttttcaaagcaacctaggcttttccaacatgcacttcaaaactctttgcggcctctacccattacttaattccaaagccactttcacatttttaggaattttttttacagaaacaccttacttcacagtaccaaaatctgtattagtctgcccacactgccatcacagcatactaaaaactggatggcctcaacaacagaattttattttcttacagttctggaggctggaagtctaacatcgaggcaccagcaggattggtttctggtaaggcttctgctggcttagagatggacaccgtcttgccctgtcttcccatggccctttctctgctgtgggtgtgctttcactgatgtcttttatctctccctctttttttttttttttttttgagacggagtcttactctgttgcccaggctggagtgcagtggtgcaatcttggctcactgcaacctccgcctcccagattcaagggattctcctgcctcagcctcccaagtagctgtgattacaggcatgtgccaccatgcctggctaatttttgtatttttagtagagacagggtttcgccatgttgaccaggctgttctcactcgaactcttatcctcaagtaattcgcctgcgttggcctcccaaagttagtgtctcttctcataaagacacaagtcctgttggattaggagctcactcttataaccccaaataaccttaattacctccttaaaggctgtatctcctaatacagtcacattaggggttgagcttcaacatattaatttgcaggggaacacaattcagtccataatatctgccattctgactgaaaacacctgcttaatatattgtcaggagattttaatgaaattttaaatgggatcatgttctattaatgttagttggtcaagagcatttgagcttcaagaacagctacaatttattgagaaatttctatttatcaggcaccaagtctgtacttaacatggatgcttccatgcctcacaatgattttatttgagaaggtattattgttggcactactttacatttgaggaaaccaaggctcaggagaaggcaagtagctagcccaagatcacacggttatcaaaaggctgagagatcccgtccaacagactctcctctcccatactaggctgttgcaatcattctgatggcccagaccttccctgcaagtgggaatccttcacctgagaacatctgctaccacaagagagaggaactgaccctcatctccccccagacagcctctggtgactttacacaccatctaaacaaagcctctggcacagccaccaacatatttcactccctattaaggaaagctgagacagggcaggcctctggacacttcattaggggaacatcaggacacataaggactgtaataaaacaggaaccgaagagggtgtccatggggaaagcccggagctgcttgtgcttgtacccctgcagaattttagaggaggaagggagggctgagggcacagagagacaagggcgggggagagggggatgagataaggctgccatgggaaagcaagagctttgctgccaacagagcaaacacaggatgtggatcccagctcagtctctccctagctgtgtggtcttgggcaaggccatttcacttgatgtaccacaatgatccaatccataagatggagatatcaatgcttgccaggtgggattttgtgagaattaaataataattttaaaaattagcatgttaaggctgtgactttccccctaatggtttcgatgaactgtaggtggacatgagggcgatctggctgcaacatctgtcactccattgacctccagggttgattcagctgatctgtctggcaagggaggtgtcctcttcccccctcactgctctatgtgtgtccctcccaaagctgtatgctccgttgaagaggatggccatccccaatagaggaggactgttttttggtcaagggcatacagtagctgcacgcccctgctagaacctccaaacaagctttcagtgagctgtaagtttatgattctccacctttgtaaattccccaaaacctctaattggtgttcagatcaggcatacatagggtaaggttcaggaaactatcttttaaacaaacacacaagagaattctttttgttgttggtagtggtagtaaatttattcttgaaaccatttcaatgagatatattaacatgtaaaaagctgtgcatatttaatgtatataactcaatgaaatggaaccttggtgccctgttagtgggaatgtacattggtacagccattatggaaaacagtagataaattcctcaaaaaattaaaaatggaactaccatatgatccagaaatttcaccctaggtaattcttatgtaggaagaaaatcctgctccacacctagtgaaataccaacagtaaacaggagaaaataatatcaggcaatttttaaacctcctagtaatagtggtagtgcaaggactttagaatcatgacacttggttaccaatattatgttgcttatgtaggatgaaatatatattatctatggattttagtctcctcctaggtgatctgggtaaactaccctaaataactgtttcaagaaataagtaaaataatgcacataaacttccctgcatattccccaccatatggtaagtgctcggtattatttctctgatagattcattttcacctagctcttgcaaatgacttgtaataatccctcaactgtggaaaacatagacacaaaaaaattttctacctcaattccaacctcacattttgtttaataaagcaatttacagggggtaaaaataattagtggttttaaatgctttaatacaagcaggcgctgtaatcatgataaatcatctctgacatatgcccagctcctccaagtgacagatgacaaacaaaagcaggacaaggtcctccgtcacaggcggaatcattgaattaatggaagaattattgcttctgaaatccactccagtcctattgaggagaacgttccaatttatcaaagccaaatgaacattaattgcagcagtctggtaagttttccagccactatgaccttcattgaattttaatccaaaacagataagatttccttccacacaagaggaaacaacacaattagctcaaaatgacagctagattatgaagcaggcacacacaaacaacacacacacattcacactcacgcacactcccagtgaaaatattgattctacttgacttaaaattcagcacaaaggaggtgagcagagaaaaaggtaaataaataccatcaccacatctgcctaaccccttccccctcttcattcaggagagaaattttagaggcggaagccaagatggagaaggtggcaggcagtaatggagacagaatttctgttaactgctgtaattaatgttatgtctcatcagggagagattaggaaaaaacagagaaggaaggaagaaaaaacaagtgttattttgctattaaagacgcccttgagctgggaacattagcagccgaagtttgaattgggtaattgtttgactgtatcggtggatttgcagacaggattaccacagtgaagtgaaatgtagttgcgctgaacctacagcgtgagtggctccctcagcatggagcaaggggccttctgctgggtgcagtttatagcctgacacaggcacactgccctgagatttagatgggaaggccagctctgtcatcaacctgctgtaagacatcgtgagtcaccctttgagacctaaaagctttgtttttgtatttattttcactctattaaaggggttgaactggagtttttaaaacgcttttgttttttgagaattaaatcagaaatttctgttttcatcaattctaaatatctgtggccagaaagaactggctgccttcttccatggtccagggtcaggcttgcctcaatatctcatagtctcgtaattggatgattatggagatgagctcctaaaaagtccttatccatccttgccccctataagaaaggaaatattatacagcagatggagcagagagctcatttggaactagaaatatatgtttaattctgggctcggacactggctatgtgatcatactagagagttgtcttaaccttctagaccttggttttatcatttgtgaaaacggaacagtaaaaacagcaatatcaatagtatcattaatacaacatttgtatagagtttgcatatttaccaacttttaactgtagaaactattactctcaccattttacagttgagaagacagaggcacagagaagttaagtaacttaaccaatgtcactctacaagttacgtggtgaggccaggattccaatccaggcagttctgtcccaaagtcaacattcttgttttgggttttagcctttttattttgaaagaattatagactcacaggaagttgcaaatttaggagagagctcttgtgtactcttcactcagcttcccccaatgtcaacatttttcataactataataaaataatgaataccaggacattaaccatgattcaacactattaactaaaccacagaccttatacaagtttcacaaatgatgcctcttccagcttatggtagctcttggttttccttggcttgggctacataatgctcatttctctctccatcttcataccatcttcccctgtgccttctcttccatgtgtctctcataaggactaatttttttaatttttttcactaatgtccttgtttttccactaatgtttttattttggtccaggatcccacattgcatttagttgtcatatctccctagtttcctccaatttgtgacaattactgttttccttgttgttgtttttgttgtttatgatcttaacacttttgaccattgcttgtgaattattttgtagaatgcccatcattgggtttgtccatattttttcatgattagaatggttatacatttttggcaagaaacccacagaaatgacattgtccttatcagtgcattacttcagtggattcataacgtcaatgtgtctgatgagtgaggatgttaattttgatgacttggttaaggtggtgtggtcagttgaatagtgggtcccagaaagatatgcccacaccctaatccctggagtttgtgaatgttatcttatttggaaaaaagggtctttgcagatgtaattgagtaaaaaaatcttatgtataacaatctgagttatcaaggtgaaccctaaatccagtgacaagcatcctaatgagaggcgcatggaagaaaagacacaggagaatgtagtatggaggcggacgtagaaattagcgttcaatagcccaaaccaaggaaaaccaagagctaccataagctggaagaggcaagacaggattctcccttcgagccccagggagagtgtggccctgccaacaccatgatttcagacttctggcctccaaaactgtgacagaataaatttctgttgtcttaagcttcttaaattatggtaatttgtcacggcagccttaggaagcaaatacaagtggtatcggccagatttctccactgtaaagtcactattttccttctgtaattaataaatgtcttggggggagacactttgagactccacaaataccctatatcttctcaaaatttcaccattaattttagtatacatcagtggatcttgtcagtagtaattattacagtggtgattgcctaatggtgattttctgtttccctctttccttctacatttattaactggaattctactgtaagaaagagcaatcttttctgccccatttatttatttagtcaattatttatatcagtattttaaagtcaatattcttaataacctcccaacatagctcaaaggatgtttgtgaaggccaagaacgataacagagtaggaagaatatttttagaggccaaaggagaagaaagggaccttccctgggcaccttgctgatgcttcatgagccttttatcacttattcctcccctcagccccatgaatgtggatctctcgcctcatttacagctcaggagaaagtgaggttcagaaaggttcagtaatgtgccaaaggacacacagcagtaagggaaagaatcacagtttaagtcctcatctgtcttgtctccaaaaccacgtgattcccaccaaatcaagctatgctctgaagactgggaaggagggagaaaggtggattaattgaagggagaggcagaagttccaatatatccaaatcaaagctcactttccatttttactgtgggcttatttggggcatatgagaaagggagtaaacagcgtgaacctcactgcaaatgtgctcacagcattcattttgtgttgctgttaaaataccacacaaaagccccaggttcttgaaggggaggaaaatgtggaacaggaggctggggcagaggaagttgggaatggtcaccaaggggacacacgccctgactctcttgccaacctgtccgcccctccccactttacttccctgcagtctctggatctcccctctccttcccttctcccagactccctgttgcaatccagtccaccctgccctgccatggcctcttctcagatccacagtgctgggtgcccctgcctccagccctctcatctctgctggatgctgtctgggcttgattgcctcctcagcctcggatcaccccgattgcccgcccttcactccatctacctcgctacccgactcccagccctttcttgaggttgagttccatctgcttctcttactcgctgtctctctcttttcctgttctcttctctctgtatcacttcctccatgctttttattctctgtttcattttcccccatctctgcttttgttgctaaatccctttctgtctgttcttgccaattctcctttatttttctatgtctctcccatccttggtgccccattctctcagtttcttctttatttctctccgtctctagtaatttcaacgtacctagtatagaatagtttctcaatcaacatgggttggatgtttctgtcggtattttcttctgcttccctctgtccatattatatatacatagctatagctatacacgttcttattctgcattgtgctttggccaggaggttcagtggaactgccttcaggcccttttcctgagctgcctcttgccatctccaagatacccttgtcaaacttttccatctgggctttatcattggcccacactaatgggacagggatgaagaacatccattctccagcttcattttccccatctacaacatgaaggtggggtacattctattgctgtggcaattgcttgcatgtgcaccccctgtaaaagaattgcacacccctgccattggctctgggcttggccatgtgatgtgctttggccgatagaatgtgagagaacccacatctgagcatcagtttcaagaggcatcctatatttttgccagctctcttgctcattccctctgccatgaaaaccaaatgtttcaaactggggctccccttcagccaaagtaccagaaggagaagacaagcagagctgagcctgcagtgactgcagctgccgatgtgtaaggtgcatgagaagtaaagcatggtgtggccaaggcactatgatttagagtggtctgtttgcagaataaacaagcaagagctgactagcctggaagagttggatattctatgaggtctcaggtgttttcagctccaagatcccactatatttcatacttctactgtttttttttttttttggaaactcttgctaaatggttttatgtgcattaagtttgatgttatgattttaattttatttccattttgcaaatgatcacacaagaaactcagagaggtgagatgactagcctgcatttctatagccggtatgtggaagtctaagcttgaaaccaggcctcctgaagccaaattccatgctcattctacttcgctatggtgcatctctaaatgttgtgaaaaataagcatttcctatatttcctacacatggaagctatggcttattttcctactttgcccacaggcctagctagagaccctgcaggcttttagtgaaaccatgttgttgaagcaagtcaagaccaagccacaaggttcatgtgacttaaaattttaaagtattttttaaagtctatacttacaatattaaaagttctactttctggaaaaaaaaacgtgaatgatactcatggggtatgtcccacttttgtaaaaaagtacttgggatatttgtgttacaaaacttcatcataccttggcaattgatataagcttggtatcttcatttttagatgggtgcagtgaggttaagaaggggatgtgacttgcataagatcatggagcatattggtggcacagcagagacacataactatttgtgctgcatgtattacatggtttttccactactagatgtttgccatcctcacattttaaataatccctctcaggatctgttttccctactactctgtcttttctctgaaaagcatttgggaatcacagtctgtaacagcttggcttctcctaccctagttgtcctgagtgaccttcaatgatattacttataaataacatggtggcagtattaggttgatgcaaaagtaactgtggtttttgccattgaaagtaatggtatttctcaaagtttcaccattaattttagtatacattggtggatcttgtcagtagtggtattattttcaatggcaaaaaccacagttacttttgcaccagcctaaatatttattgttttcagttgaattgggtcctccaaaagcaatatgttaagctcctaaccctcagtacttcagaatgtggtgttatttgaagacagggtatttataaaggcaatcaatttttaaatgaggttgttagggtgggacccagtcagagtgcagcggcatgatctcagctcactgcaacctccgtctcccagacccaagcgatcctcccacctcagcctcatgagtagctaggaccacaggctcacaccaccaaggccaactaattttttgtatttttgctatagacagggtttcaccatgttacccaggctggtctcaaactcctgagctcaggtgatacacccatctcggcctttcaaagcggtaggattacaggcttcagccaccgcacctggcctctggtgtcctcataaaagggggagaattggggcatagagacagacatcacatgggcagaatgccatgtgaagatggagttctgctgccataagccaaggcactaccagaacctagaaggaaagcctggagcagatctttccctggtgccttcagaaggtgcatggtctcacagatatcttgattttaaacttccggcctccaggattgtgagataataaatgtctgtcttttaagccactcagtttgtggtactttgttattgcaaactaggaagctaatgcacttataagtagcagagtaatgacatttatagaaccagggctgtgtgtcaggctccagcatatgtgctttatatctatcatctctgatgattctcacaacagcccctctttagacaggtaattccatcagagaaagtacatgctcaaatcccactactaccaagtcagttatggagccagaatgtgaacctcagaacacacagagtcacaggtcttacaagttagttatacttcctgtgcttattttctcaacagtagagcaggagtaataatatctattgagattactgtaagaatttaatgagttaaatacatgtcaagtacaatcacactaagcactgtaaaagtgcttgttagcattattaagattcttcaatgtcttgattactcagttattatttctactcagttactgtttctcttaagatatggccccaaaaataaacacaatatttcagttctcgcccagtacctctagaattatttgttcagaaacctagccttttattaattcaacttaaaatataagaccactttcagcaatgagaccccatagttggctcaatctgagctggtggctgattttgtaaaaagcttttttttttttttttctatctcttttttttctagcagataggcttttcattgctagatttaataggcaggtaaaccattccatgattgaatgattaaatcaatgaatgaaggaatatgctatgaatgaaaaaacgtcacggttggagcaatgatataaagccatcttttacagaaacctttaaaaagtgttatcccaatatcacaccgatcctctaaacaaagctactgaataagaatggtagtaataatttcttagatttgtgtgacattttatattcctcaaagtattattctatgttattatatcacagagtcatagatcatctaaattggaggcaactacaatagtcatctaatttaactattattcctctctaaaccccagtgactttgcctgcacaaactcagggagaagaaacccacaacttcttgattcggcctactccaccgatggatagctcagacactttgaagtgtttgtcctgtcgtgcatgagaattttgacctcttggaatcctgaatcctccctcattggaggccagcaatacaaatccgtggcattttctttgggatgatccttctgagagaaacatgccctcaaaattcttttcttctcctacatcaaaccaaacatttcttttcatcccctttctcaaaacattttgtcaccacaaagacaaaagggaaaaaacaaaagcgccaagataaaacatattggtctcaaacagtttctatctagtaactcttgtggaaatctttaaaacaagacacatcacattaaaatgaaattatatttctcactgttaaaaagggggagaggaggaaagagtagaattatatgaccaaccctctgaaccacaagtgataactatttttgttgaaagcaactttgatctatgcaaaagtgaaatatatattgaaatgccaatgtgacaatggcaatggcaacaaaaagcaaaatgaaaaaaacaaataaatgcaaaaaagaaacaagaagttgtgatcacatctgctaggacctattgcatttcctcatgcctgcgtgaagcagataaactcttcccactttcttttttttttttttttgagcagagtctcactctgttgcccaggctggagtccagtggcgtgatcctggctcactgcaagctccgcctcctgcctgcaagcaggcagatcacgaggtccggagatcaagacaatcctggcttcccactttctaaataaggataccaacactaaaagaacctctttctttatcctgcaagtttgcatatgtagatcacaaacttagctggcaaatagttaggggcccataatagcttgttctgataaacaatgtaaagtgcaccccaggattcaagccatggttttcctctgactttgcacctgtagtcaaatcactcagcctgctttggatttcttttctcctatctataaaatgctggcatgagcaactcctctccctaactgacaagtttccaatttctatcaaatgttttgtgcacctggagtgaatactctataaaataacagacatgataaccctcactatagctaacattttaataacggctactgctttttgagcacttacagaatgtcaggcactgtgccatgcagaactgtgcccaagcacacagactctcagtttggacagaccagagttagaatctcaacttcagcacttattggtgatgtggatgggcaagatgcaaaaatcccactaactcctaagccctcatctgtaaatgaagggcaacaacattacttatcatatagaggcattggaacaattagatgaaataatagaggtgctgcacttagtgcctggcatacagaaagttctcagtggtggcagtcattattttcattgtgcagggcatttgtgagtgtgatctcattccgtgcctagaaaaaaaatctctaagtattggggaatattattccagttttacaaatgatgaaggtaacttggccaaggacacaaaggtagtgatagagacattattcaaccatggagttgatttccaagtcataaaccctcataaaatacccatggattccacatagggtacagtcttcgtaagaattcactcatgaaatcttatcaatttaaatcaacaacggatgcatagagaaggaaaatggtggcctgttatatagattaagggcatagtttctgaaaccagcttatatagagtgaaaaattgggtttgccacttaacctttgtgtgatcaatgtcacgtagataggtatttattaacatttcagattcctcatgtgagggacagtatccatcttaaggtttgttgtgaggattgaaagtgataatatgcagagaacaaaatttggaacactgcctggcatacagtaaatactcaaaataaatgtcaggtattatgattatttctctagatcaggcagcaaaatagcagcaaatataagactaaagccaatgtctttttactcctaagttgaagtcctttaaacattgcttcaatgacaatattaatagccatttgtgactatgcactcagtatgtgccagcctgggtattaggcaccattgtatgttttttccactcttttctccactcttttcaataatttttctccactcttttcaataattctgtgagattggtatgatcagttttgtttcatacataaggaaactgaggctcagaggcatgaagggatgtgcctaacgtaaaattaccaggaagcaggaagtagaagagactatattcagagccaggtctgctgaattccatcgctctgctttttttctctgcatcctgccacctgcacagctgaggagggtatgctgaagctgaggcagaggacaagaggagatgactgtttactctcactttctggactaggttcagagtacttccttgctgcatcaccttttgtgatattaatattcagatgatgcaacctttgggacaaggtagatgctcgactctagccttcacaagcctacaaagcatgatggctccaccccaggaggcatggatggtagcaggttccagtggctgaatgggagctggtttccctgcatgggtgagcaggatatctgtgctgtcaaaaggggatggagtgcatagaccctagcctccagacttctttgagatttgactagaagatttgggtcttctcacaaaccaccttggatcttcaccaaagatgaaaacaatagtgtatccagcagggtcagggccatgatgtcatgaattgccagacacaagttttaatcctggggaaatcctggccccagaactgcctttttgttagcccaggagacttagacaaatcaattaaactcatgaatctcagatttctcagttgtgaaatggggagacagatcccagccatcttaaatgtaaacactctttttgttcttgctgcattgtctgtggccagaatgacaagggtagagtctgagccacagagaggcctgacctccaggccaagccctgctgactgactgagggatcttagacaagtcctagcctgtcccagacctcagtatccaactatggaataaaagggtataataaatcagcacatctcaagtttttcaactaaactgcccctattaacaaaagcaaatacccttaagtgccaagctcctctgatctgaggacttgttgtgtctacataactattagtataatccttgttctataaatgacaaaaacaagacaaagggctcatacccgagttcagtgtcagagagagacctcaagtctgtgctccaagtctgtgcttatggctgtcttcctacctctagagagagcagtgttattggcatgccccacctctcagaggaagaacaccctggggttcagtgtctccaagacatgactctgttccctgaggggagggcagggacaggagagatccagattatggagccctgaatgggggaaggaactttggaccacacggtggtagccttgggtcactttggctcatgggtggggagggtctgaagggtgccagcttccacgttacctactctgccagccaaatctggaactacagggaatttcagtgacatctgggtcttagtgagttattatttcgaagctgaactcactgagcaaaagggaaagttgaggaaaacctaccatcctggggagaaagtctgattcagtgaaactaacactggacctggaagcaaaaaagacacattggaggctcatttataattgagataatactatccaggttactgggttacaagaaggatacatgcaagtaaatgtgctgaaacacagaaaatgtttaatgaacattggtcaaaattgagtctcactctcaaatgttaaaggaagaagagcattcacacccctccgcctcttcctaacattagatggtgtcccacaccccatgaggaactcagcaagtgccctgagatggtgcttataaatttgcaccccaaacttagcatgcaggcacccacttgcttggtgtgaggctgcatcatttgctaaatatacatatggaaaaagtctatcacactcattccatgaataacacaaaggccttgatttgttcctccacgtgatgagcatgcgtaaggtccaaaattaacattgctgtctggctggggagtgtatgtgtttttccaaaaagagaaaacttctaagatcttactcagccctaatcagaatgtctaatgcacagtgttcgttgaagagaaacgagaaagagactaaaactaaaggtcgctccgttgtggagtctcaaaaaatactgctgattgttaaattgaaggaagcaatgagggttgagaggtagctctgctctgctgagtggctttatgccaatcacttcacccctctgggccatagcctcctcatatgtatgttggagataccatttcctaaccttgggtatctggcagagccgtactaaagaagaaaaggagaagtgaatgtaagaggggctttgaggaatataaagcatcagaaagatgtgaagtttcttcctgagcccattagactctgtgctttctacctactggatttattttctggttttgtttttctatctaccatgcaatgccaataaatatagctttttaaagaaagcatataatataagcccagatacttttagactaccactcaagtgattccagccctagtaaccttctgggtggaggcagcagactcagagttctgtatcatggggccaacagagctgaacagccacatcctctctctgcaaacatgtggaggtgattcgctggacctcatccattcttggcaagagcacaatgagataatttccatacatgtatccagtatagtgcttaacaaatggtagatactcaagaaattcttgaattgagagaaaacagggtgtacaggacatagttcaggcttagtagccagatatgcttggatttgaacactcaagagtagttccatcattcgctggctatgtgatcttaggtaagtttctttgcccctcagccacagtattcacaactataaagagaattatggaggggcttctgtggacccccacaatggctacgtccagcccagctacaagggccaccatgcagttgttgcaagggttaaaacacctgacacatcaagggtacttaggaaaaggcagcctgttctggttttattccaattttgtttgttcagtcattcttggaatggccagttgtattctgaatcaccaaacctcagccctcagcaaagcaggccaagcacatgacagatgttaaacagctattcccagagatgtcagccaaaaggccgaggagttggagaccctttattttcttctctgaagcacaattagtttgtcacagctgacagatgatggatgggtatgcatcagtccaagtgacatcacagaatccatctgattttctgtttctcattctaacctcttgagtttggttctttccttccatctgtggacaatcccccgccccctccatctctccacccattcctcccccacgcaatccccgaccccggtcacatccccccatcactcaccatcacagaaatgtggaggatgtgcatctgctcctcaacaatctccgagggctcctggagagtgggggcggtggcttgggccagctgcccggagctgctcatggagacgtggaagtacaaggtgccattctccagccactgctgtctccagtgcaccagcgagatgtccgctgctgtgccagacatctctgcaagacaagacccgaggcactgggtgagccgtacgcctggccttggtgctccagggaggaaaagagcccacataatcaggagctcagaaggcatccattttttgccaggatacctttcctcacatcaagtctatgagatagggatcatcactttcatttatagatgagtcaactgtgaccaagattcacctaaagtaacagagtagtggaagcagggtttgcacccacatctgtctgaggccgtttttagtacatcacatgtgatcaggtaattcattctactctgatagtggaatgaaactaaggataaaagtgctttcattcttttgtggctatggaactagaagaagatgaaggaaagaaatccatgaaaggagtgggagttgagagtgtggattctttagaagttgagctggaagtactcatggccaaacctcggagccagaaaggcccaagagagcaccaactcagctgaggtagctcagggtcatcttgcatgggaaaggagcttgccaagagggttgccctgagcgtgttcctcttgcttccacaagagcagctccattttttgtaaggtatatactgcactcccaagcaaggaaatgttggcataaagtttccttggcttaaaaatactggcaaagctactgccccatcccaacgttctcatatagccagtgaggagtgaggactttctagtaaattgtaaaattcaatctcccaacttgaagtttctaactcttatctctatgctggttttccttctgtaaatacttttaaagtgattatcatttgaatagtatttttgttcaatgtatcatacctttttattagtaaaaaagggtcatggcataagatgatgaaagtgtcattgcaaggggattgtacaattgttccaaagtccccttgactaaaggtgtatgtgcctgcaaatgtcctagaaagacaaggcctatcagtgaatcttatgcatgaatacaagagaagggtggtggatttcttggaggattattaggtctgcattcaagggagacaaacaggagacaaatagcctttataatgtccatcagtagacaagtagtcttagtggtgctagaggcttagaaccttgacccctccctcctgagacagctatgaccttgaggcagtattcctacagtctccaaagacctcgagtgcattcacacacacacacaaacacacacacacgaggagagctgataggcaagctgagttacagcaacttatccaatcagctctctccatgtcccactgcagcacccatcatatctgatgacacggaatgaaaaagaatcaacttgaaaagaagaggagatgatactaccaaatcacttactcatcacccaattccactgaactattcttatatcatcaatgcccaatagactctccctccttgaggttcacaatcaaaaatccttaggagaagagtgtttagcacttaataagggctaaaaaatgttagctacgaatttttaagttagatattgatttatcatcatcatcatcattattgataggaacaggatctaattcatccttcagctgctctgaaaaaaaagaaaaaaaacaacaaacaaaccatgagccatccttgacagcttgctttctctcccactcctcattcagttcatcagaaaatccttccaaagtcatccaacattcaaccctttgcagtccctctacatcagccacatgggacaaggcgtcatgctgtcttgcctggcttactgcaaggactccttaacttgactctcttcttccacccttgtccattctattctcagccaggagccagaggaatcctgccaagcaaaagtcatctcacatcactaagccctccatttacagtctttgcatggcctcctactcattccaagtaaaagacaaagtggtgagaacatagtaagttattaggccaagcaaacacatgcttgggcttcccttgcagctggaagagttgaacaggccttgagataatcacgaaggtttgtcagcacttagagcacaggccccaaaggccctgagaacccattgtcgttctggggaggggctgattgggtgatcaatttgagtggtaggtctcctctcagcaccttctcttcatcccaggctggggtgatctgctgccccactgaccccctcccagccttagcacccaaggccttggcagtagcttctctggcagacagccagctgggccaaggcaaggtgaagacattatggtaaatggtctggctcatttttctctcagtgcatcaaagcctaaaaccagaggtccagggaacccagggctgaaagctgcactagaaatagcagtgtctaattcagtagttccatgtgctgctggctaggcaggcactccacgtgctgagagtccctggaatggcaccagaagaaagctccaaggtaggctacatctggttgacacagcctggcacagttgaaggcggagcgagcagagggatgcttgtggaaatctgagctccttgctcctagcactctctccagcctgtgcctgaaatcccactattaaagaggcttcccctttccatgttcagatgagaaagcagaaggtctcagaaggttagtgacttaagttcactggtgaatttgtacctagctagaaccagtggatttccagtccatgcaatttctactatgccagttgcacttacatctcctttctcttgactaaattagcccatgaaccaaaactagattgagctctttgtttgctacagcgatgagtgcacaatcagcagacagtaaacgttaaatgataataacagtgtgtgaaacacagtaaatattgaatcacagagaataactccggacttactttattacaaagaaaagaaactgttgttgaagaggagagaggaggggtatgaaatgttaaagggaaaaatgctttagcagaagcagaaggcctcgatcattcattcactcattattcatttattcatgcatttgtttatttattcaacatacttatcaaacacctactcaatcccaggcagctcaatagctcagaacacggagttaaatgagacatagccttgccttcagggagctcataatcatttagcagtggaaattctacccagccaaatgtctccttgcccatgttactgtccatacacatacacactctccattgaccatggtccaggcaactgtgtgttatcgggactatcttctaccatcaccccttcttcacacactccatccctgcaggacttacaactgtttctcaaacaaggcagactcccacttgtctcaggccatgagtactttctgcccaacattcctagcgctctcctcccagaacctatgagctgtcttcttctcagtgtttgtctctcagtccaaatgatacctgcttggaaaagctgtgcctgtccactctagctgaagtggtcctcttcacacacatccaacctttattatatcccttttacaaaaactttctacagcagttatcatgattagaaattcaggctgggtgcagtggctcacacctgtaatctcagcattttgagaggccgaggcaggcggatcacttgaagccaggcatttgagaccagcccggccaacatggtgaaagcccatctctactaaaaatacaaaaattaaccaagcatggtggcatgtacctgtaatcccagctactcaggaggcagaggcccaagaatcgcttgaactcggaaagtggaggttgcagggagccaagattgcgccactgcactccagcctgggcaacagaatgagaccctgtctttaaaataaaataaaataaaataagaaagaaagaacgaaagaaagaaataaatttatgctttacatttccttgaacatgtgtttattgtctctctctccaggagagcagagaccttgtgtgtcttatttcctgccatctctcacgcactttggaaagtgcttggcacataatacatgctcagtaaataattactgaatcactgagttacatacatatatgtatatatatttcaaatactcatgccctttttcatctttaaaatgcttaatgcatatatatatatatttcagtgatttggtatatatatatttatgtatttacatatatttcagtgactcagtaacacacttacttgcacacatccataataaaatggtggagggactaaaaaatagaattcaaagagtgttacatttcatcagagaattaaaaaaaaaaaagaagaagaagaagtaaaggtcgattgaaaactccaaagtgggaaaagactctcccagcttgcaaccaagaactacttccagaaggtggtggtaggagcattgcagaggatggacagattcatgtccctcagagaggaggaggagaaggcatagagatcagctggtcatcgcaggggcatgaagctgcgtgtgtatgtcggagtggagcagaatgtcaggtgagaaatgtagttcagggcctggcgtggtggctcacacctgtaatacctgcactttgggaggcctaggtgggcggatcacgaggtcaagagttcgagaccagccaggccaatatggtgaaatcccgcctctactaaaaatacaaaaattagccaggcatggtggcatacacctgtagtcccagctactcggaaggctgaggcaggagaatcacttgaacccgggaggtggaggttgcagtgagctgagatggtgccactgcacttcagcctgggcaacagagtgagactgcatctcaaaaaaaaaaaaaaaaaaaaaaaaaagaaagaaagaaagaaagaaagaaatgtaattcacacacagagttaagggctttgaatgcttggtgatactgtgtacattttattcagaaccagtagagtacacttggtcagaaaaccagtcctgtgtcccttaaaaacaggttaatagaacagtaacatgaccaaaaccagttcttgagattctctgctgattgattttccaattgcattttcccttttctcttcccctactccttccatataaacatttcattgaagtctccaagtcatattacaatcaaagtttaagcaaaagggggactaaatgcattgggtcaggaaccaagatgattcccataaaggcagattatgctgacatgatgaatataaaatgaaacagcagatattaaagtgggagaattggtgcaccatgccttttggcagtaggctgactccagtgcctgcctccctcccaccctggatagcttggttttatattggaatcataaagaaacacagggattgccttttcacctttttctgctctcccccatgggctgcaactcgtgaaatattcaacaggctcaaatcccctcaactgccccacagaagctgagagagaggatcagccttcatcagtgattctgggtagactgccatcctgcctcggtggccactgatgcctttcagcctcccggaaaagaaataaaaaatcccaaaggcatgttgtgcttttaatcggcttgttcttcctaatctatggcactcattgtatttttatttaattcctgaaggtcattaagaaaataagcagctcttctcatcaccagccatcttggtaacatctcccaagtggctaactaaccggccttctgattctacagcaccagctgaccctccagcagattatttgctgaagcccagagaaagcttccaatgagtttgcaaatgatctttttctcactgtggggaaagcagacattacatgagatgaactcaccgcccgggcagaaagagttgggaaaggtagtggtgttgactttaaccaaccttgccactagctattccagcattcatgggtgattgtcacacatcaagtcttgctgagtgagcctgggaaataatcgcaaatactcatgccctttttcatctctaaaatgcttaattaatgcaaagctttatcatctctctcatgggctattgcaaatggttctgtgccagtcagggtctcatcagagaagaggagacatactcaggaaggtcaatgagaagtgtttaatgaagggagcatttacaaaggcttgggctaggttaaggcaaactaatgatgagcaacgaagtactcccacattgataacagcaaggaattgttaccaccctaggcctgaaggggcaagggatggtggggatgggggattatcaaaccctaaaaatgccatagctgtaggaaagggctaccatatagctaccagataagaactatagctttttctaaaataatccagccactgccaatgcacaacctaggatggaagctttcaagagggtaatttcccaacctcatcctccttctacccaccaattttttgcaggtgtctcacacaagttgaccttgactaaacgcccaagaatgcttaaatgaaacaaatcatataagtcagccttcctgggtgcacagcaggtgggaaaggggatctcaagaagtaaatgaataggctccttaacaggtatccctaccttcgggcttccttccttccagccaaccattaaatggctaccaggatgaaatttctaacttgtcaaactgaccatataattccattgctcaaaaccctccaatgttttctactatccctcataataaaacctaatttattgaaccagacacacaaggcccttcctggcctgttatgtgcatttctccccagtctgatctcttcctatgcctttccttgcacttaaatattaattctcaccagatatttatataacgtaccacatatactatgtgtttttcctaatttaatatgttgtgctcctccatgctttcataaggaggaatattgcatgctgcataagatcacagggtctggagaccaactgcttgaatttgcatcccaggtcccatgtgttcaacctgtgtgtttttgggcaagctcttcgcttcttcatgcctcagttcccccatctaccaaatgaggataataacagcacctgcctcacagggtcgtttttagaatcaaatgagataatacaaacaaattagctgttaggttggtcttgatacttagacagcactccacagttacatttgttatatattacttcatatacatagttatagtatcctcttttactactgtcttggtgtgtgtatatatatatgtgtatatatatatatatatatatgtgcatatgtatgtgtgtgtgtgtgtgtgtgtgtgtgtgtgtatatatatatatcttaaaatagtctatacagctgacttcccttattggatcctagtgcagggacatgtcagaattatttgtgtagcctggtgcctggtacagtggctgaactgaataggggctccataaatgttctgtatgtttaattgagccgtcccatatttgaagtcagatgagtgtttccagaggacagagagaagagacagcaacttggggtgtcaataatggctggattcccatacagcaactctacagaaatttacctaacatcctggagcatgcacatgaaaagaaagaaatgttaattttcaaggagcttatattttcatgaagtgagataggggaagttcatatagaaaatggactctgttatgattctgtttagacatgagtatgtgtataaacagctggaaaaaaaatacactggaccacgaagaatggcactcactaaatagtgggatcagaggtgattttaatcatattctcattcacttttctctacgttttttatactgactatattttacctctgtagcagatgcaaatactcactttaaagattcatttagtcaaccaacctcttctgagagctggcattgtgggactctgtcctcaggagcttagtccaaggggctgagaaaagacatgctataaatagctataaagcaaagtagaaagcttagaggaaaggagattacttctggctggatctaaaaactcttcatggaggagtctcaaagaattggcaagatttcaacaaatggctgtgtggcaagagggcacttcagatggagaattggcacaagggaaggaaggcaagaaggtcacaaatgtacaaagggatacagtggggggaaccggtataaaacgcagaagccaccattatagagagaggctgggggttaccaactcttgcccatggagcatcacctagcagaataatacaagtgccaggtcccacttggggctcctttatgcaatcagaccaagcccgagctcagaggttaataaagctctccatatatcatgaattaagatgacaaggtggatggactgatgggtgaatgggtgaatggatggaccacagtcattctgacttaattaaacagcctgggttagtgaagagaatactaaattttgagtcagaagcttatatttttgtgatccctctacagcacctgactggtatcctggagcacaaattacagagcctctatgattttctttacttgtaaaatgggggtcacagtctggcctacttacatcacatctaatgtagaactgagagaaaataaggccatacatagcaacatgcttggaaatctgcaaagttttacagttagtactgaaagcaaatgcaatcatccaacgacatacttcatccatcaatataccttccaataattatctactgactatctgaaatgtgccaggcacagtgctaggtcctaaggatagattggaggaaaagatcaatttgactactatcctcacagactttccagtttagtctggatattcctttgttccctctaagcagcagcaagcatttccccttgcttcagttttttcagtcatccacccatttaatcattaattcatagtagaaggcgatgcctgtctaggacattacagtcttcattatttagcatgctgcaggtgtgcaataaatatttgtcaaatcaatgtatcactaaatgtacattttctgagtttcttgtcttcaagaaagtcacaatctaggagagcagaaaaaggaaagtcagcaaagatgataagtgtgtggtaatgaccacaagataggaggtacagcttgttacaggaacacacgtgagaggtcagttaatgctcctcatttatcaggagattggacagggcaagcagggagagtctataatctggacatttcataattctaagagatcctgatgtcaggccaggttaaatgcccacaggataatgccaatggtatgctaggtttgggaggtcacccgtggggacagaaggtggagaagtggcaggggccacaacatggccaaagccctctggcagcagctggagaacagactcaagctcttctggaaagaatggtactcttcaaatagtgggattagagtctccagactccagaggtgccttagactcctcctccccaaccccagctgtcagcgctcatctctgcctctgcctccaatctgcccattaccacctcctttgggaactgcatcttttacatgaaactgttttcccaagccactcagtgaagataaataatacagttatacccagttaaataagggaggggaagagaagaattaagagctattggcaagggagaaaagcatatcgtttcagattagatttggaaatagatagagggttgctggaattgattctcattactcctagttattctctcccgtaccatttccctctctccttgctgtatttctttgcttggtctttgtcatttcgcttcatgatatgcccttggtttctatgtttgcatgctctctctgtctctctttttaaaaacacagcccaatgtcaatgagtttttctacttcttcttctcctcttccttgtcccacaacattgcaaactgatgcagagagtgggtgactaaagaatggagacaggaactaacctttgctaacacctacttacgtgccaggctaagggctttcattcattgtcgcatttagccctcataggaaacccacataggtaaagtagatagtagaacaccgagttttcagctgagatgtctgaggccctaaaaggggactacacttttccaaaccctgattcacagattccaaattcagtgttttcaccactgtcctacataggctgagaaaggagcttgcatatttgagtaaagagatcgaggaatcaagtgtatgccaggaggtgtgatatgataagtaccagggcagtaggcatccttccaggtcactcaggtgctctgcctatccatttcatcatagtaaagtcctttgtttcctctgtttttaagatgcaaatatctcctgggaaagaggtatatgaagcattctgtcttacggtgaatgagtttttaagatcactttgctccttcctatatttcactgggttgacctttaacaaattaagttcacctctctgagcctcactggcctcacatgaaagaatgggaatcataaaatcaatctcttatgatagctgtgagaataacaggagataatgcattggaaggagcctagagcagcatttagcctatggaactccctgtcagttgtctgtcttctcgtcactcttttctatctcaccactgtcaaggcaagaagcacctggttgttttgagaaaagtggtgggggtgggagggggggtgacagtaccaaatataaagaaaaaggaggcagcagtcacagagataaaacttcctactttacttgtaaacagtttccaagacccttccaccttgtccccagtgccccgtaaaccttttaaagttatccctacagcaacgatctggaatcatggaaaattacaacaggaagagagtgtaaagggatagagatcaatgatctatcccacccattttactaatatgttaaataaggaccagagaagagtagcaacttgccttaaatcacacagcatcatgatgcagtgttcttctgatctcattgtttagaagaacaacgagacaaggattcactgagaggagaggcagaacctccttaaatcccaaaagtaatttagcagtatgcgggacaaggagtggtaaaaatcccttataatgccagggccccttccaactctcctgaagatgctgccaagagggcatcttaagtctctgtttctaagtctgacttgtcaaccccaacccccacaccccaacccaggggactcagcatctgaatgccacatgcatggattcagacctgacatgtaaaatgcaatgagtcaggaaagcatggcaccatgcagtgtgatgtgtgaggaggaaaaatgaaacctgtaaaacccagtgaccaaacagagcctagaagaataaacatacttgacattaagtccaacagctatttgcagaaagatgggagaggcaaggcttaaaggaatacctttatatgatgaattaatccccagggtcagacgctggcctaaatccattgcttatgggaatcatatcatggtccactagccccaagcaacattcttacctcttagcctttgttcagaccatgtcacctgcctgaaatgccttaatcttttcttctgcatacatggatgttacccatcattcaaaacccagctgaagtgaccctctaagagcccagttcaaaatgccctctccctctcctgagccctcaactcccctggcaggcttctacttccttccctgacttcacgaacttcacccatccctaattctcatgacttttgctagatcataagagtcttctggaccaggaattgcttttatctcctctgtgtcctttttggtagctcagcaatttttgcaacagcaggagcctgacaaatattgactgatacaagattaaaatagaaacccaagtaaagaggacagcatggtgaaattcctgactccaatttcacagattggaatactgaggtagagtgtgcaggaaggggactcggagagattaagaacgagaagtgggaaggaccaagtaagagctcctcagactaagcacaccttgttttacctgtcccctaccctctccttcacccctgctttatagccccctatgccatctatccaaacggcaccaacctggaccaaatgacatttgatgcagccaaaccaggacaactgagctctcctgtgccttgtctatctctgctctgtcattcctccatgtgcccctgcctttatgctcatagatccatatccttgtttttcactgttctctgtttcactgttttttaccaacctaactcttaatcttcagaactcagatgtaagtagactacacaaacagtcaacagctctcctcctctttacatctaaaccagtgtcatgtgacattgcagatatccctgtcaagaggtgagtctgtttttcctccccttgaatcagagttggctgcaggactttctctagccaatgggaaaatgacgaaagtgacacactcagagatttgaaaagcgtttatgtactggggcttgccccctcttgatgctcctgggatccctgcaattgtcatgtgagattagcttgatggaggcagagagaaggatggcccatctgcctatgctgccccagacaaaacctgctgctaaccacagaatatgtgagagaagccaacctgggtcatcctgctgctagcaaacctgccggctgaccacagatgcaggagagagcccatagagatcagccaagaccatacgaagtgcccaactaagctcagcgtaaataaccagcccatataaataggagcaaatcaattgtcataagccactaagttttggggtgtttgttacacagcaatagctaactggaagatgccgcctcctttatgcagcatcccccctcaccccaccacaagatggggttgggctttcctgctctgtgcgtgtcacgctatatgtaatcattgcttcagttatttcatgcttcacctaccctctcctccccaagtctctgagcttcttaaaactaaaagccttgtctcttttgctgcccactacctccctaacacctagctcagagttggtgcttaatgggcatgtgtagcacagaacaaactgatgttgaaattttgccctaagagggatcctgccgtatttccctcagcccctcctccttctaatcaaagtctctgtggctctgatttgagagtgagtgagtattgattggcttcaacagtactgcttcaggagtgtagtctgcctctatattccttaaataagctccatgcctgttcggtgtgttcacagcagccttgattgtaattcagcctctactccattacccttatttatgacgtggtgctggagcacagagccccaggccgtcagtggaatgattacaggacccttttgacttgcaattccacaccattcagtccaatttaggccggccacagatggtgccctgtggcaaggaaggggtgattacaggatgccaggctgagggtggggaggagggaactaacgaccctcttgattttctctctgcatcagagaaagatgaaaaaatggctaaggttatttaatgtcccttcccaccagaacagtgtgtgcctgaattatgacagatcaagcccctctccgatggggtcagacacgagaagtcctgggaccactgtggggacaccttttaattcagtgcaagatgccagactcctctctgcaggtgacatgacagaatgttgttcccatattgccaggctagcagtaggaaaagtggaattccactcttgtctttgctctgtgacctttggtgaggcattcatttctttgagcctgtcttctcatctgtcaaatgtggggactgatccctcctctgactccttccctaggtcattggaggcagtaaaaggaaaaattcaccagaaagaactttaaatagaatgttccctgtgcaaaagtcatggttatgattaatgccaatcaacctggtggaagatgtctagaaaactgaaaccaagaggctcaacaggaaaggctgaaattccctgctatttttttaaatacatcagctccccaatatagcacagggccaggactcaagctctaaaaccagccacctggattcccacctctgccactctattagttgaataaccttccagaaatcacttaacttctcaaaatctcactttcatcatataaactggtgaaagtagcgtcataataatcactggagcatgaaagccaggaaggcaagcactggtttgtcttagtcatcatgtatcacagtacctagacagtgcctggtaaaatgtaaccacttaatctaaaaataataaaaaggctaacacttattaagtgcttactctgtgcgagtctctgttcttagctgtgtgcacatatctcatttcaaactcctgacattcccatgacttaaggataatgataaagccacaggtaacaatgctgagttactgtgccagcacaagaaccagcacatgtctgtgctcaataatgtctgcagcagtgaatgttgctactactatctcctctgcggtgctacacaaataaattgcttttactccagttaatatagacatcatttgagatcacttgctttgaagcaacagagcctgtctttgattgtaaattcctggaaaaaggaaaagatacatcctttgaatatcctcttcaggccactgtggttacaacctggaatatcctcagggtgtcggactagaaatcaagacatctcaattgtcacacctccctctggctcccaccccacttggttctttccatttccagaatcacagaaactctaaacttagagtagactttgtcaactcagcaaatgtttccagagagcgtttcctgcaccaagccctttgtggaagcttttgggcataattttcctgggtctccacttctcatttagagtcaagaaagctgaaactcagagagaacaggggagttatcccaggttacatagcaagtcagggatagggctggtgagaatccagcctcttgacctcaaggacacgctctctgtactctacctgccagattctgagtagcctccttgctctgccactgatgtgctgtttcacccggggaacgcacttccctttctgaacctcacttttctcacctgtaaaatgggaatagacatggcatcttcagaggctgttcagaggatttactaaagaatgctgttagtaaagatgctttgatctcacactgtcttaatggaaactgtgttatgctatcagaaaacagcgacaactacaccttccagtctacatgataaaccttatacacaagtctcagctctattatttatctgagaataggaactaggagaaggggggcccatctagctggtgtcccatccactcatcccatgcaccttttttgaatgtttttctttaatgaccactgactcagggctgtaactctttccctcataaccaccaccctaattcctatctactatgtgatgtgaaatatactagaaggaacatgttgccagagccaggaggaatgtccttgtgatgggcaggtgtgcctatcacagagggaatcaggctgtttactggcattgggaacattgggagtgaggaccaagttagataaatcatctctagggcgtatatacattcaatcaggctaaatggatcataggtacacaaaaagccatgtttatacaacctaaaaacccctgtgaaaatgttcaaccgggggaacacacccatttatatgtctgttctcttaaagtacaagtgtgctcacaaacacatgtacttccttgtgaatctatgcatctgaatctgacaggaaagcattcatatctcctcctatgcacaaacatatatgttcacatatggctgtttcctcatacgcatgcatgtctgcacagactgatgtgttcatgtatgaatacagacaataatgctacagagtagaaggttttgcatgtaaaacctcacacacacattctataaaactgctccctcctaacactgacatcatgagtatttctgtatgtgtgcacattgatgcattccatgacacacgtaaacttgcatcctcatgtagatatgcacatacgtatgtgaaaactttgacaacacagtgttcacagggatatgtaaggccctcccacatgcatgctcctgtaatgtgctcactaggttcgcccacatatgtacatcatgcatgctccattgtgaatgttcagaccagcatatgtgtgcactggttctttacacaggtaggcacatggccaccttcatgggcagacatatgcatatgtgctcaggcatgcacatgcctgccaaaacaggttttaacccaagggcatacccaagccctcatgtgtgtcctcaaatacatgggtacataaatgacatcaggaaatgtccttctgagcctctgaaatatctctggatctttcttcctagaggccacgttttgcactcaaacagaaagaccaaatcctctcctgcggtctcctgaaagcctgtttcctcttttctggtatgactgacagactgctgtagagcacagaagagcagaacagccttgttctcgaactgtccatccacttaatcctttctgattttgttatgggaaaaaaatttccactgatttgctattttatcccctcagcctggtgtccttgaaagagagagatactgacacatggcagaaaaaggtcctctgattcccagctccaggcggcccagtgaccttcctctgggactctggcttccacacaccatgcaggaaacctggccaggaagccaaagctgatgtcctggatgctggggcaaaatcaatcaatcaatcaatcaatcaatcaatcaatcaaacaaacaaaaaggagaaataatgcattaatactccttcactttccatacagccagacattatgcttatcaatgttgcacactgcaattcatgctcaacacaccctcgagggacctattagcaagcccattttacagagaaaaaaactgagattcccagaggtgaaggcactattctaaggcactaaatgcagttagtatggagcacatctgcttgcctcaaagcattttaaaaactcaggagaatctggaaggaagcaggatgtgttactactgcctggcctctggaatcctcctcatttcaagtgcactttcaggagtttcactccctggaagaggccaagtgcactgcagagtcatttttccaggctgatcaaggaacagggacctggataagaagagaaagtttggggaacaaaaggagaaatagagtaggacaggagaatggacaggattggcaagaggaggagaaaaaggagagggagaggacagctttaaaaggtggtctagttcatctacctttaaaaaaaaaaataacaaacactgagccccttctctgtgctggacttcataggagatgctggcagtgaggggacagaacaggatttttcatccatgaaactcctagactagtgcggctaatgcctgttgcatatggcatgtgaaaacttgagtgaactttccaaatcagtgaagaaagagagatgaaaaatgacctccccttccataagtcagcttttaccactatgggcattaattatccatcaagcctattatgcatgttttcctgcataatcctcacaactacctttcaagatggttattatatcacattatatattcatttatgtatgtgtgtatgtacatgtgtatatgtacacacgtttggctcagagaagtgcagacactacatgaaaatcacacagtatttcagcagcagaggtggcattcagactccctcagctgtacttctgggtccttggcctaagccattccttttactgccccttctgccactggctgcatctactacttatggtagctgacacaaaatcagttatttagcctaagacagcagagctagatagaccttaagagagaatctagacttagcaaaactgaggttaaaaaagatgaagtggcttggccaatgtctgaactaggactagaatctagccttctgacccctaagatcaatactgtttgcagaatgcgctttatggcaggccatgcgtttttaagaatgacaactcttcaccctgatattgctgacccagaaggcaggaagatagatgcaggaacagtgatgcctccaagttcttctccaagtgctagagataaagcaaaccttccatccctaaggttataggattagcaatcctaatttacagataagccaactgaggccaagagagggaaagggatttggctacaaaaaagtggggcagccctcctataccaaatctaggaccctttcccatagaattcactctgaacagccctggaagcagctgggtgtagaggattagaagacaagtgtgggaggcaagcagatgggtggttccagaggtacccccttaattgctctggaatcttgtgaggtcacatagggcctagcatttagaaaggtcccatgctgagtttaaggctctgctgtcaccatcttgaaattacaagcaaaggcccccacgttttcattttgcactgggccctgcaaattatgtagctggtcctgtctttgacacttttcctttctgagcctgtttcttcatctctggaatggggtaaataatggggtaacttgacagggtgtgcagccaatactgtcttcccttctctgagccaaacatatatgtatgtgtgtacacatatacacaaatacatacatgcaaacatgcatcaatatataacaggtttgagagggcggcatcactttttctcagtcaaacacctttccctcacttgtcctcagttaacttacctgtaaaataggtttgctaatcctatagccccaggggtggaaggcttactttctctctcgcactaagagaagatcttggaggcatctctgttcctgcatctatcttcctgccttccaggccagcaatatcagagtcagaatttgtcattcttgaggtctttcccacctcttccttggcgctcgtctttctagtacagtgtagtaaagcattctcctgaagacacctgaagtccctgctttcctagtcctcatgcagggcaggccagaaatgtcatggagttttaagtcttccacctatcttcaccccaaccaagagcagcccttagccaaggacagatgggaggtggaggataaatgccctagtgtgggataattcctgggcacggttttgttgttgttattgtttgtttgttttttgagatagcgtctcctgctctgttgtccaggctggagtgcagtggtatgatcacgactcactgcagcctggacctcctaggctcaaacaatcctcgcacctcagccacctaaggactacaagcacgcgccaccacacccagataatgttttattttttgtagtgatggagtctcactatgttgcctaggctggtcttgaattactgggctcaagcaatcttcccgccttggtttcccaaattgcttacaggcatgagccactgtactctgccatttggacatgttctatcctgtcttccagaggtctccaatgagattgaaccccagttgcccacagcagtccttgatcaattatatgcccttcattggctccccttcctgcctgtctctcttcccctactggggctccctgggaccacctccaaaagaaattacttgcattcatctcctcagcctagggtctgcttctggagaactcaatttaagacagggctgctccaagcttaattgagataatgcatataaagtgcttagtactgcatcaggcatagaggcaagccctcaataaatggtaggcttacagaaaaaaaaaaaaaaaaagctactttacgagaagacatgaggaagatgacagaacgtttataattgatttctaaatttatcctcctaatgaaatcatctccggcagaccctgttagtgaccggtctggaatgattttcagagccctgtttcccaccagaggcacataccagttattctggctcctaggacccagcccaaagtgaaagctcatgagattgccatccactctttttctggccttcacaccaagtgagaagggagcatagcccatccagaatctcagagcctcagcatcagagtctcatctatcgaaccctttgttttacagatgcagaaagtgaggagcagaataaacccaaagtcactcagtatgtaagatcaagctcagaagaagaaatcaggcagcctgccattcactctccaaaaaaaacctctttattgactgatatattcattctttttaattgtcccacacacacagagatacacactagaaagtaagccccacagatataaggggttttgcctcttttgttcactgctgtgccctgcctagaatagtacgtggcccacagtagatgctcatgaatgttcgtgaagtgaacaaataatttttccatgacacccatagtctatccctgttgaagctcttcctaatttgcctcaggaagaacaagtccaaaggaatcagagcccaccccccattatgaccagaatagcatggttagaggaagctccagagctccaccaccaatgtgaaccccagctccaaaagtaagtccccaaaaggccttagtcaagttaccattccctccccatcttgcaatagtttactgtatttatcaaaggaggtaccccatatgtaaaacactaaagcactagacacatatcagctattactaaggtagaaagaaatgcccttcttccccccagagacttctctcttgttgctaatatattcaggaaaatttttccaaagagtgggaaaatgcacctatgctggttaagaggatgactaacatgtaggctattttcatcaaagtaataaatagagaatcacaaaataaaaacgttacatcctctccagtccctttcagttttttgttaaccaccaggaggtggttaggtgctacaaggtctttaacaagccagagaaagcaggcttcaggctcaaatcccaggcggactgttagtctcaactggctagagtgtcaaggaattgctttgctttcaccggacttgtttttatagtagccttctaattttagtaagtgatattagttttccaatcatcattatgctattgaagtttccatttacaatacagatattactttagaaaaattaaaaatcagaagcaaaagacagaatgcagacatggtcaaaatgataaggatggccctgaaatgcctgaggtttgggattctctggtctagtcttggttcttaagtcatcaggacaaaaactcagggtccagggctccatatcagctctgccattcacttctgctccgtaactttgaacacaaccattcccctccctgggcctcagcccctaacctttgaaatgaaaggatcagatgtctaaggctccataaggcctttccattttggaaacattttgaatccttttaggaaaccaacaaaaccgtaaaaaaaacccatggaaaatgcatcaaggccatgtgggtgcccctgcctgtctcagtgatatctcactcccaaatgaaaatttgcaaaccccagagtcttgttgacacccatttgtttatttacacggcttcactttttatgtggctttccttctttctgcctaatgcttgacaaaggaaataatgccagaatttaggaacccacgttcagaatcctcactcattagagcacttaaggtgttcacacgtaacaccagggtggcaatctcaatctcctctgccctcactacctgcactagagtcccctgtgcagtgtttgatggaaagagccttgaggagggcacacaggtgcttctgacagattctcaggaaagtcaaaacctgggctttggttctgacctggctcttccgtttggattttatcatatttactaagctccagttccaaggcagccagagacagggaggagtcagacaaggtcttctgctgctcaatggggcctcagggtggtcaggtggacattcagctcatcacatgcactcaaggcagcctgagaagtgcagtcccagagacaggaacatgacagagaggtggcgcaaagaagaagatgcttaatgatgccttaagaagcaaccataggcagtttcctgggcagatgaggactatgtgcaatcatgaagaatggacaggtgtttaccaagtgaagtggggaaaagcttttcaggcacaagttgaggatatacaagacattgagtgccactgattgataaatgggggccaaagtcaccaaactccccaagccaggagcctccagaaccagccagttagacacttggaaaggactcacatggtaagacacagagttttcatgtgaatagatggtttaggacacagtcctgcatgtgcaaggaggagcagaatttcactgcctcaaggaaaattgaaaaagctatagaaagccttgaaaaccagactcaaccagacctttctttctcaaccttctaaattgtatctgaatttctcctttatccctttgtactttgacacttacctccatgcttcctaaactctccttcccacttctcccttcctaaaaattccctccttgttttgtgcaaaacaaaagcattatgtatcttttccctaactaacaggcagaagcttttaacagatttctaatgcactgctagatgattccttaaggcttaaatccccaaagacaccttgctgaaaaagatagagacatctgtagttactggtgctttgcatttgattgttttcataaaacactgctaacaatgcatccgtttcactcacaggtagacacacacagagttaacctccccacccccaccatgaatgtttgcatgaagtgacatatagatgggaagtcttattcatgctgaacaagcagcatcctgggaggaaaagggtctgcattagcaatgaagacacagggttcagacagtgagtgctcttggccaaacctggaggaacacttccgaaagcaagttcacttctcttgtgccaagatctaaatatagcccacccccccaatttaaaatatgagccaaggacctgtggccctgcggttgctgtcttagctgctggattttctcaatataccccctacccagatctaaaccaagtagggttatatattatcatattatattatattatatatcataaaacacatattatcatatattttatattgtattaatttattttataatatacaatatataattataattattatataaaatatgtataattatatatgatatgtttttataatttttatggtatatttattatattatataatcacatataattatatgtcatatagtaatgtaatataattatatgtagtattatatgtaacatacaactatatataaattatataatatactatatattttatataactatataattataattataatcatataagtatacgtaatattataaatatatatgtacaactatttatataaatatatttttattatattgtaaatctagcatgatatattaatatgtaatataatatacacataacataatattggtatgatgaaatatatgcaatatataataatatattacttaatatatataaatatataataactaattccttcaaggcatattcatgacagtaataccaaatgcttactccaacatacctggagatgttttctatcaaaatctcctgaatttagcacctctagccttgctaaaactataagtgattacacctccctaaatgacctaaagcacttccagatgtttcatgaactttaaaatattatacaaggtatttttctcctcttttctctatttcaaggaacaagcacagtggtgtttaagaaggtcttatgtaattctcagcaatgacacagccgtgcctattttccagtttcctttaagaatcacaattagaggcactgcctgcgcactcagctgagttgttagaacagtgaaggtgcactgctttgccagccctctcccagccgccaaccatgtgagtttaaagccagcctggatcatgatcaaggtaatccaactaggcttcttaccagacctgagaacttggacaaatcactggcactgtcccaggctgtttcctcatttatgaaatgggagtaagaacaccttctcagccagggctgctgtgatgtatgcatattctgacatacagcagttctcagtaaatgctcatctcctttttctttcttcaaaatgttgtgcaattggttttctttggacccatgagcagaacttttcattatgttgagtttcagttccttaaattcagcccatcatagaatgggtcagctctccctgattctcgttgagattcatgtttgcctgaaggtctttttaatttaaagtgggagcactccacaataagaagtgaaaaagaaatccaatattaagtatttggacattgaagaacttcagagagtaaaacctccaggcacataagtataggctcccctgactacacaaaattgtgggcagatggtagtcataataggcaacgtctattgactgctcgccatgtgccaagcactcttctaagttatctgaatgagctatctcatgtaaccttcacaatactaggaggtagatactcatattaagcccatcttgcagatgaaaaaactaaagtgctcgaagatttgacaacccatcacaaattgcatggcttagactcaaacactccactttctcgctctccagcccatgcaattaaccactcctctgcaatagcttccctgattatgggcttctggaatcaggcagcattgtgatgtgtgctggcttcaacacagatgacctgagtaccttctagtaagtcagctcctggtctgtgcctggggatatctcactaataaactgaggataattaaatctcacttgcaggacagtgttgagaattggaggtggggtgagcggtgggagagggagagaatgaatgacagatggatggagggagggagagataaagaattgtatgttgggttctcactaaatggtagtttcttcactctctccctcatgagagcctcccagggtggggagcgatggaaggggtcatgtgacggctcatcgacattggtgtcttgaccatggtactatatataagtgaccatgaaggagctagaagctctgccctagaggaatgtgggaagatgctcaatctgctggtatgcactctggctgaggacatcactccctcagaattgtgtttctgcctccattgaatgaccggaacactctaactccttaaaatcagcacaatgctgggcctccccatttcaggtttccatatgggcctcatagggagaagaataaaccacaaactgctatgggggcgtgagcagtttcctgacatccagacagcttatagatatctcgcagatgttgccttgggcctggggatcctttggtctgggcccaacgaaggtcagaagttgtccaagaaagatgcagtgaggctgaatggagaccagaaggaaacacactgggtgtatctgggcctcaggtatataaatggagagccctctggctctgtttaattctctctgcttctcttatctttttgcctctcccctttgtgactgctttcttatttcttctgctgttccttctgttttccctctactttccctcccctatctgctgccactctcctcactctctctctctctgtgtatgtctctctctcatacacacatgcacacacacataaacacacacagagaatcccattttcctcaggaggctgaaatggaacagatttggagccttttatgttgaatagctttgcacttcctgaaggtatttcagagcctcaggaagcctcccaatgcctctgcctccttccgtgtttctcatcagctcaccataagtcccagtggtcatctgtagacccctcaaatgacaggactaaaatggaacttaggggtggccctatctagatattattctgtgctgagtcagcagagcccgacaatgcctgggaaggaagtagcagctgcttggtgcagatttgttgaatgaatacactaatgaatgtaagttcttgactccattttgcaggtaggataactggttccaagatagctaagtctcctgcccatagttagttaatggcagaactagggttttaactcacatctccagatacccggctcattccccaatccctatgatatcaagagtgtcaagcccagggctctttttaaagatgctttaagtgcccctgggagtctgtagattctcctgggaggaaccacacttccatccatcaccagccattgacatcaaagaagagactggctcatgagaaccccaggaaaaactgatgagaggatgccccagagagcccagccctctacacagtgcactcacaggtcagtgcactggcaggtccctgactcccttagtgccagctcttatctgtccactccagagaggggctgtgacccaggacagagagctggcaggactgagatgcctaaggtggtcacacacctggtcagaggagctgggaactcagcaagggtatcagatccaagagatccaagggtatcagccctttcccctttggagctcatccttctttcttttgaactcctgttgaaaccacagtgggatgcaggcagaatgaaactgtaggacaagttgcatcatattcatgagtgaagcagcatagcacagagataaaggtgtgctttctggagccagcctgactaggttcaaatcccacctctgctactcatgaatttgggtgcctttagaaagttgcttgtgttctctatgcctcagtgtttctatctgtaatatggggacactgataatgtccatccttatcactaagttttgtgaggacagcacttaaaaacttgcctggcagaaaaatcaacatttaaaaaatgttaggtattatggtcattattatggtgcatctgaatccaacatgaccacagcgatcttagagtttgggctactacaaattctgtggggttcccatccaggcttggttaatcttaggcttttcttcttcctggcttggaggagagagacacctgtgagagttatcagatgttgaagagcctctggtaccagggaggccaggaatttcaacatcgaggttaatttagtcatgctgtacactctgaagaataagccacacctttcctgtttgcccagcttgacactctcacagtcagactcaaggtacaaatgagctgacctggccaccaaatatgaagccagaggggctttagaatgaacacatccaatgtcctctgtctgtgaaggaaaatcgagggctcaagcaggtacacgtctcagtcccatgcctgagcaatcagctgctgcttctcccacatggtactcccttgcaaaaggcctggagctgcccaggttctgagatcttattgttataaggcacttcatgaaaataaagtactcctaaaggaccaagaggtgctggttcagccgctcctctgagctggggaagcgggggcgagtttcaactagtcactgcgggaggcaaattaaggcccatttgttttctacagggcacctcttggaaaattgcttcttctgaggactcctgggaaaaattccttctcttccaaaggtgaacaattttctccaaaagaaccatttattccgataagattgaagtaatcattaaaggctgtgctcctctttgtatggatgagcttttttttattaaatatgtagtgaggccccataatgggttgttttatgcagatctatagtctcaccttccatgtgacaatctaatactcaatgaatgctcacctctattttagtccaattcttcctcccagcagcacagtgggacacttagcatagtagaaataatagtaataaaacctgggttctaccacttaataattgtatgaattcaggaaagtcattttacttgactcaactgtaaaatggggataacaaattcatcccagtctacttcacaaggcattaatattatttttctttttttgagacagcatctcactctattgcccaggctggagtgcattggtgcaatcttggttccctgcaacctccaccgcccagttcaggcaattctcatgcctcagcctccagagtagctaggattacagtcacatgccatcatgcccagcaatttttttttttttttttaatgtagagattggaggatttcgccatgttggccaggctggtctcaaactcctggcctcaagtgatccacctgccttggcctcccaacatgctgggattacaggcattagccaccctacctggccttcacagggcattattaaggctcaatgaggtatttgagtttcctccctgtcagcaagaccccattagacacaacaaaaaatgaggccaagagatctgcacatgaaggcggtaattcccaaaacccatcaagacatttagtgggagacataggctgcccagttcccaaccccttaatttctctactgcaccacaggtttaagtcaacaacatcagaattgattcactgaaagtggattcaagtagaatttcttttaaatgaactttatggttcttttgcctcctccaaaaaatgaggacagtgatgatacctacttcacagggtagcaaagtcaaattaaacaaggaagtgaactagttttgtcagtagtgaggagaggcattgatcttagagattattattatttcccctgtttgagcacagagaaaactgaggcttagcagcagtaaggatgactgggatgctcaccgaaatacagatctcaaggcccacaatgaaatgaaacacataactgaaataaaatacagaactgaactgaactgaaatgaaatacagaactcaggaatctggcagaagcccaggattctgcatttattcagcttctgtctgggttgactttatgcaatactcaagtttgaaaatcctcaaacaagactgtcttgcatggctcttttcacataaaacagctcaccacaggccagggcttttccatataggattatatttgctgcttagaatcatactgaggggtaaggattactatactgtcacaacctatgaggaaataggttcagagaggttaagtaactttccaaaagtcacagagttgaacttcatatcccaagttggtctaactttaaagtctgtattgactccataacatgactctgcccctccttagtgactagaaccaccactttgtgcctcctttcaaggcactctggggagcattcacggactctgagcagcactgtcacatgtgctaattgcctctctcatagccctttgatttccttacctacagtcaggtgatccttcctcaaccccaaactccccgtaactgccacccccacctgatcatgctgcatagccaatcagaagaacagcactgatttccactttgcatcccagcctgggacaaatgtgatggcacagatcaaaggaagtcttggaattaaaatgtgaaacctgcagaggcatcttggggtgatggacagcctgatgttctggtgtgctgcttgcttgtgcacattctagatgtgtaaaaatgcccatctcctccacaactctgtcaagcaaggacacacaatgtgccccatcagttttttttcacacagtgttgtccactacagaccaaaaccaaacttctagcccaggtggtgagagaaacacgcctgcctaaattcataggaaggcaaccatgaggtccaacactttgaacagtggctgtcatacagcgggtgcttagtgaatatctgtggatgcagtagaagaatcaggcaggtctgcaggaaattatgcagtggcatgcctagatcagtaccaggttgagagcagatactcaacaaaatatttttgtctccagaaaaccataaatctttctggctgcagggatcagtctcagatttcagggcctctctctggccttcccaaccttctctctaaacaaaccagttccaaaatgttatagactcctatccaaagctgtgtgccccactcccaccattctttgctaaacaactgaataatgtcatgaataaattcaggctaaggtatacatagctcctagtaaaaaattcagaggaatggaatcaagttataaacaccatgaaagttcactgtcatgcatctccaactccaagacaggaggggtcaccatggtgacaaaactagcggatatttgggcaaggagtggggatgttctgtgattcatcttaaaccaaataggtaaccaccttctctgccaggccaggttctgatgctctagaacagagcttctcaacattggaactattcacattttaagccagataattatttgaggtgggcgctatcttgtgcattgtagggatgttgagcagcctccctggcctctactcattagacaccagtagcattccctgctccaccagttgtgacaaccaaaactggctccaaatatggtcaaatgtcctttaggagaaaaatcacctcctgttgagaactactgctgtaaagagaaaatgatgaaaatttactaatccaattaatacaaagcaaattctttaaaaaagccatggtgtctttcaccactctagcctgtgtattctggtccctctgtttggaatcttctccctccctccctccccatcttatccccgggcaagcctttattgctccataattcagggatcacttctttgcaaagctttctagaatgtcctatgatgggataggagatagacccctcctctgtttgacagcaagttgtactcccccttatcacattatggttatccctctgcactcttgaacaaaactgcacattttgaggggaaggtctcttcttcattcattttcaaattctagttcttaacaccgtgccctagcactgaataaatacgtgtatgaacagaaggctaacacttaatgatcacctgccatgtgtcagtcctactgtgtatatcctatcttggtatgtctttatgttaatgttgcatcataggctactactattactccacgtttctagggagtaattcgttcccagagagcagagataactcatctaacatcacacaggcagcaaatggcacaactgggcatatggacttaagtctgcatggctgacattctgcctttctgaccttctgtcttcccatttgcatgcttgccatcttgcttcctacagtagccaaagacagagccctctgccttgggcttttaggtcttggggaggtgcaccttgctgcttcctccttaccaggccataaatcctgttgaatctgggcagtgaagtggcaggcaggttggtatgagctttgttgatgtgtatgcctgggcccccagcacaggcacaagttgggctggagacccagggcaatggaagatttctttccacagcagcacagaccaaagcagaggactatgggcattttcaacactctcctgtctctggtggtgttattattttccttcaacctttccagtaatggggaccttcggggctgaaataagaacaataatttttttttccttctactctcctagagtcaagtccagaatttaataaaggtaacaaaaatactacggtattccaattcctctctgcagatttttgttttaatttagttttagccctgatgttagattgacagtcctggggtctgaagtgtatccattcccatagtatgtctggtgcagagacagagtgactcatttttatgtgtgcacacacacacatatacatatacacacagagataccatgaaaagaacaatttctcctacaaaatcagaaaattgtctgcattaaactgatctgtgcacagtctgtctgccccacctctgaccccccaaagcctcattctcaaatataaactggcattccaggcaatcaatcaagacctaacccctcaaagactaccaccaccaccactaccatttgatcctaactgcatttacccaacgtctggaattaacctctttgctccggccttagatagagcctcttcagggaacatggatcttagcttccgaaaggtttatggctttgccagcctgaagacttcccaatatctctggcaatggctttactccagcccccacccttcagaacaccatcccactccctgttcttactctgaatcactgacattggattcattcaaagaggctggaggtgggggcatggaagaggctcaacaagcacaaagaaaccttcagtattataactcaacaatgttttcagtgtgaaatatgtccaggattcaccctccttctaatactaattatttcccacaaggtttcctgttgcaaacattctaatttcttttctttctttatatatatattttttattttagcccttgttgtagctaggcagttattatgacacacatactttgttgatgaggaatgaacactcagagtaaaactgagttaaatctacatctgtgtaactcacttcacttaatcgaccaacaaatatttactgagtgcccaaatatcggctggacaccatgctaaattcaggggacacaatgataaataagacatatgtagtcagtcatgtgccctcctaactaaggagaaagaagtgccaatcagcccatacagtacataatcccatgtgaaaaaaatgcttgatgggacgagcaacaggtggctatggaaggtgaaaaaggaagcccaacccagccacactcatgcaagctcacaggaggccaggacacctatgctgggagctataggatgagtagaattttccagggaaagagaaaggacaaaagtgttccagccaaggtgaacagatatgtgaacataaggaaacaatagatccaaatatggatggtattagtccattctcacactgctataaagatattacgtgagactgggtaatttgtagacaaaggaggtttaattggttcacagttctgcatggctgaagtgacctcaagaaacttacgatcatagcagaaggggaagcaggcaccttcttcacaaggcagcaggagagagaagagtgagtgaaagagggacttgccaaacacttacaaaaccatcatatcctgtgagaactcactatcatgagaacagcatgagggaatggcccccatgatacagtcacctcccactgggtccctcccttgacatgtggggattatggggattacaattcaagatgagatttgggtggggacacagacaaaccatatcatggatccttcaaaaaactagaaaaaaaattatgcaatcccagtacatagatttggggaggcagggagaggccatagcaagtggtgaggctagagagctgggcagaggctgaagcatgccagacctcccaggccatgctaaggatctggaatttctcctgatatccatgggtagccactgcagagatttaaacagtttaaggagggatgagataccttggatagctctctgtctactctaccctcaaaaggaagggatatatctatgggcagtgggagtgaaagggagtgctatggggagaaatttaatgcagaggcagaacttgtctaggcccctaaagctgggaattctgagaggcggtgatgggtctgggacctggcatgctgcatttcaggagcactgaacttgtttcaatgtccaggagaagtgggttgataacagagagtggaatcatccatgtaacatatttattaataaaacaagcagacaagagacgccatctgaagcatagacttttcaccctgagccctgagggagaggctgatgacaggctagactctggccagtccaacacagattctggcctccccttccagatgccacaagacaattctggattatccacatggggatgtctgggccagagtgtacaggctcacctctcagtttctgaccctatagccagatgcagacagttgccctcctcctgtctttttcattgccatgggctcttcaggcagcctctctgatgttcattaaaacagtcagtctggccagtctcaagtctgagctgggcagactgagattgatctcataacaaaggagctggacacctgggcttgaaacccccctctcctccctgaatttggaatctccttttcccctcttccctttccagcagactcctaaatgatgaagagtgtctcatcaattcccccataattacctgctgtgtgtcctcacggagactgataaggaagtaattaggatagacatgcagggattacaggaagggaaaaatgttctgttgtcaagataatgccactttccctcacgccctcccagacaaataactgggcagggtttgaggattgttagagatggagaggctggaaaaggagtgaggtgaacagaggtggaagaagaaagtggaaatatgcatttcagacctgaaggggtccttaataatcatctaatccaggagtcccaaactcaacgctgtcagtccccaggcaggtcatataagtgcttggagcagaagagatggaagaacagccatagtacatgcctgatgacaaatgacaactgacacttggccttagggagttaccctgagggaggggtggggcattctcatccctttcagaagaggccacacagcggagcttcacagcacacattgccatgcaggaaggaagcccagttttggcagctcttctaatttttcaagagaagctggaaatccagctgttgtgtgaaaattctcatttttttctcactttggaaacttctctgttttttttttaatttaacaaaatatgagccaaacaaaatgatatctgcatgccagatgtggactgtgggcagccagtttgagatctctaattttagtccagtgccttttttatagacatggaaatgaaataagtattcggagaaaaagagggttttgcccaaagtcacagagcatgttaatggcagagtcaagactcaaacaagctttagctccttactctcccatttttcacaatacttaaaactggaggctgagcacagatcataaggaaaaaaaacaggcatataaataataccagtgagtgcaagcagagatatcgaattgcccaaagaaaattctgcagtggaaaatgaaaacatcatttcccatggtagttgtgggagaagggagaagaatgtacaaaaggcttaatacacaagggactaaaccatttcttgctttgatagaagaatcaggagcacccacttctgtattagaggattgaaattggggatacgaacacagtcccgacccactaagcagctaggaaactgatatgtggaaaggcagacccataaatcagtatgggtgatgaagtgttccaagtgccaagagagagtatcttcaagaaattagggtgagccaagataaaagagtgctgaatctatatggaagtgatggtgataagtaagtcctcaaagacaaaatgacacttgatatggaatttgaaggataaacattttaccagttaatggagcagtggatataagttaaatcctcaaggacgtagagcaatggtccccaacctttttggcactaggtacctgtttcatgaaagacaatttttccacagaccaggggagttgtgggggactggttttgggataaaactgctccacctcatatcatcagacattagagtctcatgaagagcatgcaacctagaaccctcaagtatgcagttcacaatagggttcgtgctcctatgcatatctaatgccatggctgatctgacaggagatggagctcaggtggtaattgctcgctgcccactgctcacctcctgctgtgccatctggttcccaccaggccatggactggtactggtctgtggcccagggattggggactcccaacaccgacaattgagacatttgaggacaccctaattacttccttatcagtccccatgacaacctacagcagcacctggaggggatggactccaggcagtgagagcagataagcaacagtcccatggtagaaatgcatggaagtatataaagcaggacagtgggggttacagtagatagggtttatgttcaaggaggtagccattggaggcaggctgaagaggagagttgagaccacatctgagaaggtcaagtgtgccaagcaaggaagtgtgcatatgttaagtaaaaaatgggcagctgctgaaagtttgtgagcaggaaagggagatcatgacagtactggtgtgtctggggaagattcacctggcagtacataaagaagcttgaatagcagcttgaagaaaccgatgcagaagtccctagggaggttgtgaagagctcccttatcctccctccttcaacaaatatttgcaataagacactgcaacaagcatcatgttacaagcattatgctagaagcttgggatccagtgataaataaagcaatcattcaacagatttatttcacacatagtatgtcccaggtactctttgacggcagggttttggcctcaatcatttcagagccaacaacagagtttggcgtctagtaagtgctcaataactgtttgttctatctaattttcatgaaaaagcccaaagggaaagttaaaggaccgagcttgggaaatttcagtagagctcaaaggcatggataggagagaagagggctgtggaatgaaaagatttctgattcttagatcaggattctgagtttcattctcgagtccttgcaattgttctataaccctgaacaattccctttctcggactcggggtcagtttctgcatctgcaaactcagggaacttggagtagttcccgaaggtcatccatgaaattgaaagcatgatcagatgggataggttgcacgcatacacactaaacatgatcaaatgggataaattagcacagaggaagatagtatagaatgtgcagaatctctcagcctaggaggatagaataccaagaagagaaaaaaagacagaaagaaagaaaagtaagatttgagaaactttgggactgttcagagctgctgagctgagtatctgtaaacctcttgaatcatctctctgccatgacctgccccctgaaagacctcaggctgaatgatcccttctgtgtcctgccactttcattattataattactgagtccattggtattctctagatatgctatatgcggtggaaaagcactttcccaatgattgttaattaatccctcaccactcctatgcctgagagggactgcttagtggcctcatttttcatcccagggaaatgggcacagaaaggggttgaaggttgacagggtcactcagccaggctaaagctgaatcaggactagaacatggggcctttctctagccattcatcagctgccccatggatgacccagccagagtgccacagagtaaatgggtttagcaacaggtcgctgtgagaagtgatggcaaatcccctatagagtgggtgacggagagccatctcatggcgaggaaaagaagagtggagtggatgccctgtggaggttaaagggaaaggaagatgaattaaggtttggatgccatcgaaggagtctgaactttataaggaaagcctggacttctactgggattcagagaaggaaaatgtggcctcttgctgtagaagcaaagtgaccttctgtcaggttaacctgcagctggagggccaaggaagtgtgacattccccaacaggtcagggaagacttctaggaagcagctgttgcaccttcttccaggccaagcaggtaacctactgcacttccaagttctttttttttttttttttttttttttactttttgaaatttttattataagcatttgctaccctttaaaataattgaaacaagattttttttgaaaacacaggtatgaggtagataccattccttgttccttgtccactttcctcttttaatgtagagatcaagttttggccagtgatatgtgaacagaagggaaagctcattgtccctccagtgctgacacaagaaagcctgaataataatgtagacaggaaaggaaagagggagaggagagggagaggagagggaatggtccctcccttgaaggtagagactaagttcactttttcacatggattcaggggccctggcactggtgggtgaagatgaattaggattgggttttagaggaaggggagaggaaactctgctattcttagtcaaccaaatgacaaaggggggtggacatgcagtggaggtgagaggagaaaccagatgcaattccttctccaagatcacttggcaagaagttctagctctcaggactccatataaagtggccatactcagttgctgctggggtcataaattcagagcccagaaaagatagacgactgtgatgaaaatagctaccatttattgtttactatgttccaggaactgggcttgacactaaaataataatagacatgactgccattgctaagcacacattctcctaggagttgtgcttggcacttctcatgcactctcccttttaattctcaaactgccccatgaaatgggaactgttatcgttcttattttcccatgaagaaactaggactgagagaggttaagtagtttagccaaggtcaccagtaactggcaaagcatggactcaagcccaggtcttagtgactccacagcccttacacttaatccatctgaggacttgcttctctttacccatggttttctccttaataagggaagctgatggggctggagtgcctgaagaagagcctgcccaagtcaacctggatgctcccattataccctcccaccaggacactccagataatgccaaagagggaacaattctcaggcctaactcctgctcattttcacacacttcagcctgaggcttcaagaaacccaactgacacaactagacacagtgaaagagaaattagccagatgttggggatgagtggaaaaacagagcaaagctcttcacctgagtccctctccgaagcccctctctggattggttcctggagggactccctgagcattggtttgtgatctccatgcaaagagcagaagagaatagaggacggcagggctccagggctgaaaggagccaatagctcatgttcctccatcccgacttcaacacttcagcttgaccattggtgtgagaccctgcctccagctcaaataacttttcctcttcgcctcctccccacctaccccttcctctgtgtcattctacatgaacacatgtggagagagagaatgtagcagacacagctcatctttcctccccagctgcaaatgcaatgtaccccttttaacaataataggaaaccccaaattcactgggcaattcccacctttctttgtagctagttgtaaccatgaaactgagtcctgtctaaagggatataaatggaagttagtttaacttgcagaaaattcctgaaatgaaggggatgtgcccttctccggatcttctctcctttccatggctggaatgaggacacattgggtagagctaggataggcctgttggctcatgaagtgaacttgagaattcaggccatgcacaacatagcaacaggcagagggaccctgtgtcctcagcagtgtcctgcagcatgcaacacctaagacagaaacaaacacctacttgtgtaacccacttgggttttccgtcacttttggctgaatcacttctaacacagcaagggggtatttgatagtgaagactctaagtgtcccaatcacagaagtcatatgtcctatgtcttctgtaagttggaggcagagtctcacactgatggtcaagctgaagtgtggaagtcagaatgggggaacctgagctattagctcctttcaggcttagagcccgaggtttcctgccttcctctttcccttctgttctttgcatgaaggtcactaaccaatgcccagtgagtcacccagaaaccaacacagaggggctttggaaagggactcagttgtgtgtgcttccaaacagtagggtttgatagaaagaagggctttggagacagaatatcaattgagcctcggtgttctcatccattaaattgggctccgagggttaaatataacaagccataccctcctgaaggaagggctatgtctgtcttgttcattgacttatctatccaccaatgatacaaaacatgactgacatacagtgctggataaagaattgataaataaatgggtggtgtgcaccaagcacatggcctatggtgggtgctcttggaatattagcgattttcaacacaatcctgacataccttctctatcagaacttttgactctgatagcagcttgtgaagattaaaacaaaagcccatcgaagatttaaaaaccaaaaacgaagtctgtgagttaaatttctgaattccactgcaaaaacacttagggagggagggtctcatctcccttttaaaattggaatgcagaaagataattaccttcctctttctacagccttcttagttcctctctcctcaacaaccctccattcataccccatttaattttcacacatgttcttagatgctaattttctttcagacttcactgggcaggctcctcagcttctgtctgaaaaggacagaacccagaaaactagaaaatgtagggcccactggggagggtgtcagctccccaccaccaaggaaatgtagatttaatacaaaagggaaagaaaggaaatgaatgaattctttttcttcaacttgttttcttttttttgaaaacctactttgcttcataataataataaataataatcagctatcagatatctgctctgtcaggctttagctaaatgtgttgccaccctttatagcataactttcacaacaagcctacaaagtagacaggattggctgggtgtggtggctcatgcctgtaatcccagcactttgggaggccaaggtgagtggatcacttgaggtcaggagttcaagaccagcctggccaacatggtgaaaccctctctccactaaaaatacaaaaattagctgggtatggtggcacacgtgtagtccgagctactcaggaggctgtgtgagaatcgcttgagccagagaggcagagtttgcagtgaaccaagattgcaccactatacttcagcctgggtgacagtgagactccatctcaaacaaacaaacaaacaaacaacaacaacaaaaaggacacaggattagcctatttaacagatgagaaaatgaaggcttgggggcttaagtcacttgcctaaagcaagagctaacacctgctcacatagatgcatacacaaatgtatataaccgtactattcacaatagtcacaaggtggaagctacctaatgtccatcatctaatgaacattcagctcaatatggcatatccatacaatgggatattagttggccttaaaaagctatgaaatacagatgcatgctaaaacatgaatgaaccttgaaaacactatgtttaatgaaagaaaccagtcacaaaatactctgtattatatgattccatttgtgtgatatgtccagaaagtagactagtggttgcttaggggagtgggtagtgctggggagatagggagttgatagttagattatggggtttcttttcacggtgataaaaatgttctaaaattgacaggtgatggttgcatgtatctgtgaatatactaaaatccatcaaattatatactctaaagaggcagattatattgtatgtgaatcatatctcaatcgagctatttctatttaaactgatgcctgaacccatgcctggaaggctcccaactcctgttaattccacctcatcacctgccattgacatgtgccacctcattgaatgttcagaatgattctgtgaggtgtgcatggccgctctcatctcacaaatgaggaaattgagggccagagaggaaaaataatgtgttctcttgcaaaggaaaatttaatttagaggaaaaaaaacctgattttttcaacatctctaatatgaggaaaccacccaggttcattataaagagaaaatgtgagagcagcaacagactctaaaatgatctagccatcttcaaactgcctccaaaacaccataaccaaaagatgcccatgtaggtgctccacagttattgcagggggggttggaacagtttttaaattatattttagatactgggcttccacataagacttcaataaaaatattactaagagagtttggaagccaccgatcttgtccaacttgcccattttattttactttattatgctttttagtagagacggggtttcaccatgttggccaggctggtttcgaactcctgacctcaagtgatctgcccgcttcagcttcccaaagtgctaggattacaggcgtgatccactgcacccgtccatttgcccattttaaacataagataattgaaagaggagagaaacaaggtctctctgagccacatggtgagttaatgtcagcactaggccagggcctgtgtttcactgcttccatgttgtgcactcctcttgtccagattaatggcctggtgcatgaagaataggctgcagaacctggtttcacttccaaaccatgctgcataccagaggtcaacaaacttttctttgtaaagagccagatggcaaacattttgggctttgcagatcatatggttttccacaattaacttggttattatagtaggaaggcagccagagacacataaaaaaggggtgtggctattttccaataaaatcagtagggggctacagttggcctgagagtcatcatttgctgtctccttctccaaacagatcctatactcttctttccagggataaaagggctggcatatgatgagcaaagtggtcactctttagtgcctttgtaggaactgtccatggtggtagtgccgggtggtggaatcaggaagttctgctttcaggtgcaggcttaccttcactgacccctgagactaggatacatcagccacaccttgagacatttatttttaatatgcggaaaacaacattcaccctcagggtcactgtaaggattacatgagaagtggtatatcagggctttttttttttttttgacggtggagagaataatgataagcaaagccaggcatactccttgccttcatctcccagcattctgcctctaccacctggttccagccaaactgccctccctgctaaatgccttttacacaccagccacagtggcttcatagtcctcactccctcttcttggaatgcgtttcctaagagcctcctgtggctcactcttctcatttttcaagttttagcccaattaccacttcctggaagttttcctgatgattatttaaaatagcaacttcagaccaggcatggaggctcacgcctgtaatcctagcactttgggaggccgaggcaggtggatcacctgaagtcagaagtttgagatcatcctggccaacatggtgaaacaccatctctactaaaaatacaaaaaattagccaggcgtggtggcctgtgcctgtaatcccagctacttaggaggctgaggcatgagaatagcttgaacccggtaggcagaggttgcagtgagcatagatcatgctactgcactccagcctgggcaacagagtgagactctgtctcaataaacataaaacaaaataaaataaagtaaaatggcaacttctaccttgcacccccaggggctcactccattgctttattttattcatagcccttaactgctatcttaaattccatcacttgtatatttatttacatgtttattgtcagtttttctttaagctctaaaaggacctttctgcttttctagaatccagaatgctgcctggaacatagtacacatgaataaatgtttgttgaaagaaaaatgaagaaatgatatctccaaattgctatgactttctgaattattttctccaccataagctcctatgtttggcaagtactaggctttaacacaatacaaacatctccatgttaggaagacagtctgatcatatattcctcaattcagtgtagttttacctggaacatagaaaatgtatgatgcaaattatctgagcctctaatgactctgattgtcaagagttggccttgcaactgaattgtaggagggtcatttcattaatttccatagtaagttagatctacagtttaacttcattcttacttatattttgttaatggggaaatcaaggtcccataaaggagaatggattttttcacagtcttgttcttcactgaatgaggaaccccttaaatcaatgaagccataaaatcctagtgccacaggccccttaaaaattaccccatctaataacatagataaagaactcagagcaagaagaaaaaaaaagggacttgctcaagatcacccagcacttcaatggtagatttaggaatgaaatccatatctatgtgtacccagagttggaatctcactactctcccttcatgctgctatttggagaaaaacagaaatggagaaaaggaaatgaaattattccaggcacacatttagcaatgctcataaatcctgacaatattaacaacacacgacagcttcgttgaacaaattggcagtgagtgtaggcagcttaaggagacaggaggtctggaaaggaaaaaaaaaaaaaaaaaaaggaccaccaggcatacacaaaaattttcccattctgctcttttctaagtctgtctgtaaaacaaggcctcagacaggaggtgctggggaatggtaagagtttgaaggaggtgcttgcatggagtgtgagtgtatgtatgagcacactggtgcacagctcccaagagactgtatggggaataatcctttgtaagatgtcactcatcctttatacaaattaacctccacctccctcatgctgggattaatttgctctttgtttccttgacattcagctagggagatctcagaagaattaaagaaagttcttcaagaggtgaaaaggggaagtcagggcttctggggcctggaaccctgaggaatcatcacccgatgcagcgcttccctacagggacaaagagggagatctcttgatccccatctcctatctgcaggaggaagcccacctcagcccccaaatcctggtaagtaagaataatatatcctgtttattctgtgcgtggtctatgcattccgttgagtactttgccagcgccatactaaatttcaccaactcactgccatgaaggttctggctagcctaggttttctgccacattcctgaccttgcctaaaatgtttgattctctagcctccagtcaaatgggttctggtttaaaggaccatccacatgattcctcagacttcccatatggccccacccctttgttctctaccccaaagtttcaggttcatgtcagtctatgtcctcaaaaggtccagcactctcccagaactcgaagctttagccattatgaaaagttctgacacaaagggagaatgtaaaaataaatataaaacaccacaagatacatgctcaaaggtatggctcctccgtttttcctcttagctgtgtatctgtttgctgtcagtttgcatgaataaataagtcacctaacattacttctggaaagaggagcaatataaataaatgcataattaagaataaataatgctaacatcaaattaatgaagaggggttttaaaaatacatgtatgcaaatcacaccttaggtgagaaatctaaaaaatcacacataccctatggtacctctgcatcagtgcaacaaattactatgaaatggggaattcccattttatacatgggtctacagaggccaatggagaaaaaatagtcatgggttaaatggcatattcaaagacaaaattattggattggtcacagggcaatgacctgtgatttctgggttgcagagatcaaaattcctgcacattaaggcctatcctaataaactctgagaagttagaatgcggagaaataaaaagagaggtcatttttaattctttattatctaccatatgtttcaaaagaccaggtatgtgattatgcctggcattggactgggtggttgcaagcattgttcttttcattcttataacagcaccgttaagtaataacactatgtcaggtaagcacagtgaagagtagagaaagaaagcaactttctggaggcaaaataactcttaagtgtattctgtgcatttgtataacttcaatatgtttgaatttttactgctgggattcccttttaatgatgagattaggtaatgaggtatcatggagagaaaagtggggagcttccctttaaataaccaactagtagacactgttttaagtgaaaacactatatggggcacaatgagtgagctcatagccaaggggagaagcagaagcaaacacaactgacctaatatccaaggcatgggggtgggaggccaaggtgctcatgacctcgggcaagccaatagcaggtacaataaattagctcaccttctctcacacagctaagtgaggtaacagatgtgatcatgttttgccatgtacaaagtgctaccaagaatctgtattccatggaattatcaaaatctaattttgtccttattcatataaaaaataaggaatcgatgattatctcgcatttatctatctacaacttcacagtgtttaatacttcctcatcatcctctcatcctcacggacatatggagagaacagaaggattaggaaagattgccattttcttccaatgcatctactagtcttctatgcagcatctgactatttgttaattattattttctactcaaattactattcaggacaactagtgtcctgatccaatctcgtgctcaatataacctcaatggatgtgtctcccccaaccttttaatcccccaaataaagcatgcccacttagcctctatttcttcctagacctgcatctaaaacctcctttcttgaagcatataagcaccttcaatcctacagatcctatccatttatcagttcatccatccattcagccctcctcccatcttcaaatctttccaaaaactttttcagatgccccatcttgtgctgggcacacataagaaaaggtcctttctctaaggagcttagcaattaattggaaaaacagaggatacttaaaacataccctaacacgtagaagaaaacgatcaatcatataagacaaaataggggaaggtgcttcttcccccctccaccctactggcactaatctaccaagctttagctttttaatggctttggtaggcactgaatacgggtggattattgggttggtgcaaaagtaatttttttttttgccattatctttttttttgccattatctttaatagcaaaaaaatgcaataacttttgcaccaacctaatatcttaactttcaggcctggtcatcaaaactcaacagcacacctgtccatgggaactctcttttctacctctccagacctcacagctgtgtgcgtaattttagtcccccagctttgattgctatctctcatcaaccacatgagttaatgcagttatctaggggacaggtagacactaggatgtagactgactgcgggtgatgatgggggagctgtagacctgggctgctgcttgagctgctgtttgatcccagctttccctcagggcaagcagaggtaatgggcacagcaggatttaggcatctgtggttcctgactacaacaccatcaaacccccaattttctctcacaactggtattagtatttcacatctagcccatgaggcaactgaggctcacagagggcaattgactttgttccaggttacacaactatcaagtggcagaatcagggtaggaacttcaatgtgtctaactccacgagcgctctttccactatgccacaccgcattggagctgagatttgaagggtacacatgatctgtgtgccgcagaggcagaaagaggcaaggtcaccctgtcccactttaaaaggtctgctgagatctcacacacatgcacatgcacacacacacagtccgctgctgccacacctccaatgtcatcaggccagctgtctttacaaaagccaaaaaaaaggaactcctttgccaacactccgtttacaaagaataaaaagagagaaacatcatgccttttcctgaagaaactttttctgttaagaagcaagaacccaacagcttccctgagacccatttttcatacgattaatgtcaggcctctcatgtttcctaatgaaacctgacactaactgagaaaaatggatacattaatattgagttcattagtaaatagattacccaaatgtttggggtgaggggaggaagaaggtgaaggaagaaggagaaaggggaagagaagcacacataccactcagctattctggcaagagactctctgaggaccacatgctaatcaaatatttatggattttaatgcaccgatctgttaagccaggaaatagtctcttttacaaaaaaaaaaaaaaaaaatttaaagaggcccacatgataccatagcgttttatttagatgggaactgaggcctgttgaggaaaaggcatggcccagagtgtggccttagttacctggacagggagaacaaatgacagctctcagagacatcagaccctccctgtcctcatcccacacacacctcttcatgtcaacagaaagtgtcatgaagcattcaagaccagcctagccaacctggtgaaacactgtttctactaaaaatacaaaaaaaattagccgagagtggttggtggcatgcacctataatcccagcgactcgggaggctgaggcaggagaatggcttgaactgggaaggcggaggttgtagtgagccaagattgcgccaccgcactccagcctgggtgactgagagagactcagtctcaaaaaaaaaaaaaaaaaaaaaaaaaaaaaagtgtcatggagaggaggaggggtatgactacttcggggaagagatgtagcctggcaggaacaccggttatagaagaaaaatgcccggtgcaccctgctaaatttttctgccacctctaaagaatacatcaagggctcaataataactactctctaccacgctaagacctgtggggggaatgaaggcaaaatggaaacagaagaagcttgttattggagccagtagagcagaagaatctggctcttccccttccttagtgtgagaccttggacagctctcataaaatcactgtcactgagctccagtgaggtcacaggcagaaatgctcttaatgtaaattgtcaagtgccataaaaggcaccatgttgctcttttgacaagatatccccttttctttatgtctatgtgatgaggcacaaagtaagggtgaggaggctaggaccccggtcccagttccaacagtgattcatggtgtgaccttgtgcaatgcccttcctccctctaggcttcagtgtgcccatcagcaacatggccaggcaggaccactactcaataaccatgtggggcctttgcatggtcttgtgcctatgacaaccctgagaaggctctaggaggaggccctgctcttaagcagtgccagcatggtgctggctcctctagggacccaaggttatccttgattacaaggtcaaagtgaagagatatacaggattgaattatctcttacaactattgtagttctcacattttgtgttttttaaagcccttgagcaaggaaatctcatgtcatgctctgaagagaaaacaacttaataaaagtgaggacagaaagaaagaaggaaatagtccaggtagaaatggaccccagagaaagtaaatgttcatgaatcaaatcgttttttttcctggttgctgcatttctctctgtcatgggtactttattcactgagataggaatgatctgccaaagcatttttacacacaagagatggagatacacagacagatggtgagagacatagacagacacagcctctaagctaggggcagaaactttcctgttctttgtgagcaggaggttaagaaaacaaaaagaaggagaaagggataataataattttttgaaaaatcataaagtagcaaacgatcaagcaaaagacaatgccagattcaaagaaggatctttgtattccaaacagcagtgacatttccttaaacagcaaagtggatccttttatctgggtctttttatgggccttttgccaccagatttatcagcagagagagaaaagcatgaaaaggaaagtgtaaagtgcataggaggatacaaagcaggaaacaaaaatgcatttttcccccaaatcttctaatgagactcactagctctattgtgacaaagtgagaggtctctgtggagttcatttcacatctcatccatcctcagagtaatgggaaaatcctgccttgtttctgcaaaataccagcacacactgtgtgccatatacactcaattccattagaggtaatggaagaagattgttccagaagttgttttcaattgcttgagtgcacccttcatttagggaaacaagaatatatgagctgtttgactcaaattgaagtatggacccaactttgcagctatagctatggttattctcttctggatgcctaggtgaggacctggtcaaatatcacctctccccatggttgaagagataatatttagcatctccatttcatgtcatgtattacaaagcagcacacagctattcattaactgttgttaacggaactcaggtccccgaacaaaggcatcctgggtctgtgaataggacaatcaggttcagagacaggagaacccacatgctaaaatgccagatggttgggagcttgaatcccccattctgccacttctagatgctttactgttggcatgccacttagcctcactgaaactcagttttatcagctgaaaaatgaaacaaaaataatacatgtttgttcgaataattcaatttatgtggcaaggctggtgaaaagtctgttagaaatcatatagaacttgggaaatgctaatgagcagcagtgaatcggagtttcccaaagtgagtcctgcctctgaaccatcctcttctttgtgtgattttgtgaatttagaaggtcaggttttcagagtagcccagggatcgtttggtactgccactaataaactaggaacatttggtcatttgtttcctctggctaggtcctggtttcctcacctacaaggtcctggcttcttcacctacaaaatgaggggagactgacttaacacgcaatattaccattttcaaactgtgttttcagaacagaattgtttcttccaacacggttttatatagaagaaatagaatatccataacaaataagaatgggttaacaaataacaatgcggaccaggaaccctgcatatttccatgtccctgatgaccttcagtggcatctcttctggggaagccaagggtactgtggcatactttgagtcttgacaacattgagtcgccatcaaatgacattctgggaggccacagaccagaagtcccatgggaatttcaggagcttggtgggttggatagctttttcctgattggcttccaaagttaggcaaggggaatagttcccccctcactgcatctcacactcacttcagaaaaactaaagtaggaagagtcagaagtctaacatcagtttaactggccaaaatcaaagtatgtgcagggctgcaatttctctagaggctctaggggagaaactattccttgccttttccagcttctgctagctttccttggcttgtggctgcatctgttcaatctctacctttctgaatgtgccatcacctcttctgtctgaagtcaaatctccctctgcttcccttttatcagaattttatagttacttttgttcaaactacattctgctctaaattcacttgtacatagcttactcatgctgaagaatcaatttgaaagctcatccaagaagctttctcggattcctacagtgcatgaacttgcttttccctggaatagagtcacagaaaacatttgaactgctgtgatgtcattgacaatagtaacaatagataacgtttgtgtggcactccccaagactcaggcattgtgataactaacactttccatgaataatgtcatagaattctcacaaacatcctgtgagatagacactattattttcaaccccatgtacatatgagaatactgagagttggagagactgagtaacatgccctagatgactcagctagcaaggaatgaaaagcacattctaactccacccacatatatagttccaggatcccatctctctacctcacattaattagttctataccagctttatgtttcctactagaatgtgcatgttttaaaggctgagctttctgcatttttatgcccctcctgcacctggcacaatccctgattccatgaataattaattgaaaaagaaataaaaatataaaagaaagaagaaagagatcaaggaaggcagcaaggacagaagaaagtagaaagtagagggagagaagaaggaaggaggggggatgaaggagctggaaatactctgaaaatgtcacccaaagcatctctgtcttagatgttactccaaaaattcctgaagcaggaaaagcatctcccaaggtggccccatcattagttccagtagagagacatggggaggtgggaaaggagatctctccagcacagcatgcctgaaaaacgatgccagaactacacagccttccacaaaagcacgtggagaaaaaaaaacccatccccaaaagcagcattaacaggagaatattaaaccctctaccatggcacagtgaataagacttcaaagccctctacgtatggaaatgaatcctgcaggcaggtttgggagctagagctaggatgccgggcaccagggctgatgaaagcaaaggcagtgtgaagatttgctcagccatgataagtccaggtccccaaagaccctgcccctcccctgcttcattcattcccaggaccctgggagttccagaaggaaaagtgttgtattaacgctcagtaccacaaaccacttggtaagctacctggcttctggaagacagcagtgcccagggttgcctgtgtttgtctttgtgtacacacacaacctatgcgcacacaccccatagagtgacacagaatcatggacaacatagcagctccttgtatgagaagaagcatgtttctcttatgcaattcatctccttactcctcaatgatttattttgttttcatttcttcatccttgagcctaaagctaagggaagaggaaagaatgaacacgggtttcaactctagacctaagagtaatgaaaagggtgaggcagagggaatacaggggagggaagcagcccaggcagaggcattgtgtgcaatactaatgtgaatgctgcccttccattgctcatttttcctaaaggccctgatgtatttttcatccaaacataaattagttttattcatttatttattcaggaatgttgatatcaacactgacacatgccgcctgtacaagagtggggaacgtttttctccctggggcatgaacaggttggggctaaatgaaaggacccaggaatctaaggaagccagggttagaggtgggagggtccatggagataaaagagcccaacttggagctgtgttttctgcagcacaaaggagcccaggagaggactgccaggagccaagcctgtagttaattgaatcctccagccagcaaggcttgctcttgctactcatgctttgttttattattttacattcactcctgtgaatgttcaaccagtatatattgagtacctagtatgtgtcagccacagtctaggtcctaggccttcagtagaaaataaagagttaaaaatccctgaccagatggatttacaacctaaaggagcatcagatgtaaacaagtatgaatcataaccacagctactttctgagagctctcaatgtaccttgcatgactctaagtgcttcagacatagtaaatcacttaatctttacaaaatccctaccgtaatcctgcaatgatagataaggaaactgtggctcaaagagatgacgatcttgcccaaggtcacacagctgataggtggcagagcttggttttcaaactcaggctgtctggcccttactgaattcaagcaaattgaaactaaacaaaaacaaatgcaggttacaactggtgttaagtgccatcaaggaaatgaacaggatgcaatgacgagaaataactgaggcaaagggcttctctggacaaggtagtcagggagggcttctcagaggaggtaacatgtaaactagagaatgctacagattgttaccagaaaatacatacacttccctagtccactttctttaaccttttaacttctttttctcttccaccccatctcttcaccaatatcctcaattctgcagttttcttattagacctacttactctcattaattagttctgtctatccactattaaggttttcttgtaactcccattctgcccattctggcctatattttaatcctcacattgccacttagtgaactaagaggcaaaaaaaaaaaaaaaaggaaaaggaaaaattataccaggcattttccagatgttttattgtctaaccctcagtggaggctcaggggtgttacagaatttttccaaagctacctggcccatgggattacaaagagtaaagatgagactcacttgtactgactctttgtccagagcaccctgttattccatcaaggttttagttacttttttaaaaggatttgcatatctcaaatcaaggtaaggcatagaacactaggaaacagtataaccaacgtagagtttactaacttctgtgctaagtttcttggacaaatgttgtgtaaatgcttggtcaggttcaggatccagtagaatgtacagaattcagatctgtattatcctacagaattcagatccatatactctactgaattctgaacttgaccatgcatttagatagcatttgtccaaccaactaaccaaactcctaacacactcacctgtgcttatttgctacaatcctattatcttagtgcagtaagagttgcccaattctttcattttacagacatgaaaattgataccaaatcaaggacagaatctgggtttcctgacacatcgtttagcagaaataagcaattaaatatggggaaaaataactgtaccatcatatgtgaagtggtaacatagatatcttagatgttctcctgccagtagtgagagtgaacctgttcagggccacctctattccctcaaggtgatacatatgatacatgggtattaaaatcatacagacatgggttcaaatcctatcactgctaacctcaatatattcatttctctgaacttaatttccactgtctgcaaaatgggggccctaatacctatggtttaaggttgttatgaagattaaactggaatacacataaagaaataagattaatgcttgacacagcatttgggctcaatacacacattcttttttgttaattatcattaaattagtcaagacttactagtctacctacaaggctaaagggcatcctgctgcttctgcggtgtgtgttatctgaggtgggatgacctggtatatctggcactggccgacatccaagtagggggctttggagtgaaaactgtggaaaatataatgggagtgaggtcaagaagaaaaggcacatgcagtgtttctccaaaatcatgaagaggttggcggttgagaagcactctctacaatgactaatggactttgtggagaggtgggcttttggagtgagacactttagaaattccttcatagatacattatactgatagcgcacacatagatggctgtcaacaatgagagagcgcttcctgatttagtctctcatttgctctcaccaccacctgggaggttgccccagctcttcactgtgcatacaatatgctagacactgcatgctagatacggctaagtctcctcacgttctcacaacaagcctgtatgtaggtcttatcattaacctcattttataatgaggaaaatcatggttcagagagattaagagtttgccctgaatcacacagctagctagtaaggccttctgctttgtctagtgcaattctctcttgtaaccacacccaattatctgttctttatgtagaaatataaatataaagcaaatgttttttctgaaaatcagaaataggtaataaattaaaaatgagaatgtggtggctacaaccacacaaagaaagcagcggattctcaagggctgggaaggtgtgaattgctaaagaggaacaaaaagacacatctgacctcacatctctccttgtgcaaagtccccagcactggatgacaagggcacatgtgctaaagggcagtgaaggcctagggacctaagtgttatatgtccagctttctgaagactaacatggcatattaatttagatttcaaaaccctgtgcatgctgcttagttggaaactaaaggaaatgaaaagaaattctaatcagggtctattaccagataagaagattacacttaacttacattctcattatttttaatatttgcaaccaacattacaccaagcttaaaatcagagagaagcataatccatttataagcatgaaggtaggtaactggggaggcctgttcagcctaggcctggcacttcaggtcaacccgtctcccaaggtggggaagattaagcaatttggtcaaaggcaaaatgaagtggatattcaaggcaattttccaggtagttcagtctaaaattgaccactctgactcaggatgccaaacaactgagaacataaacaaaatattggggattaactctatttctcttttaactctaccgatactcatttcaatttgccattcttagtctgcatagacataatccaagagatgttaggcagtgtcagatacaagcatgtctctgaaaatgtgtcccatgacaccctatatctacatggcatgaacaggaaagagggtgttctatcgttaaagaaatttaggaaatgttgagataagcaaagagaaatggatctatttactgtaaagttgctcggagcctatttacttgatatgctgatttgtgttctgtatccttaacatgtgtatatgtgtttgtttgggtgtgggtagtcatttgtctacagccttattcttgaccagagctctgcaaatctgggctaagattctttcagctcctttttactgtgagcaaaagggaggcaaagaaagacatctcaacttgtattttataagtgccaaacactttgtataaagccaagggcttcattgctataacattaggttggagtatttcattaataacagatctcctaattcattttttatgatcctgtcagcacatagaggaatttgtctctgtccaaaaaaaaaaaaaaaaaagtgtgtgtagcatctaattgtgtgactcccctccctctgccccattaacttggaaaagaagaattgctggaaaaggtggaggaaagtcaaaacaattgagttgtctttttatggatttattgagtggcaactggtgccatagagagagctaggcaagggcggtgaagcatgccgggaggcccattgatcatcacggacctgggtcaaaaaggattttatcttctgtcctcaaatccaaacggtatgctcatgcacacgcacagcagacaggaagctgccggggcgggtgaaggctcagtcctctccactctagtccctcccaaggagagatcaccaaggtcatagcagggtaaggaacatgatcgtctctgcctggccttagaagtcattgattccagtttgttcccttattaaatgagaaaaaaatgagggccagtgtgcatggcttgcctccctatctaagaaaagttaagtttgcttcgaacttgttgagaatctatcttggactaaattcagcagagatggagaaattagacatggccccctgccttcaggaatctactgttaatgggggtgggggaaagagacaagtgaacttattcatgctgtggagagaggaacacaaaggttcagaaaaaatactgaaaaagaatcgttcactagtccttaagagaccaggcagctctaaaaataagatggttattccttcctccaggaagtggagcttaattgccctctccttcagtgtagactggacttaatgactcacttctaatgaataaagtaagtaaagggaaaaataattgtcttgcagtggaaaaacccaatggacactgccccaaataaatgatgaagactaacatcagcaataagtcaggatgatatcagagactccctgatatgatatgatacaatatgataacaaagggacttcacctctggccagtgcttttcataactgttaagataatttttaaaggaaaacctgagagactgtcacataacagaggaaagcaagtagacataaggattaaatgcaacacagattgaacactgggacaaaaaaaaggacattggtggaaaccgagtaaaatctgaataaagtctatagtatagttaacagcaacatacaaatgttgatttcttagttttgacacatgtaccatgataatgtaagatggtaacattaggggaagctgggtaagtggtatatagaaagtctctgtataatctgtgccaattttctataaatctaaaacatttccaaaattaaaagtctaagaaaaaagatatagtactacagaagggttctgagagattaattactcctgcaagaaaggtttggagaatagagaaataaaaaacaaggctggcacagtggctcaggcctgtaatctcagcactttgggaggccgaggtgggtggatttcttgaggtcaggagtttgagaccagcctggccaatatggtaaaaccccgtctctattaaaaatacaaaaaattagccaagcgtggtcgtgggcacctgtaatcccagctacttgggaggctgaggcaggaaaattgcttgaagctgataggggggtggtggttgcagtgagctgagattgtgctactacgcttcagcctgggcaacagaacgagactccatcttaaaaaaaaaaaggaaagaaagaaaagaaaagaaaaaagaaaagaaaagaaaaatcagagacagtgtagtcagagggaaacataggtccagaatgagagaaaatgtgctcagagcactttgtgtatttgatatgatggcagagcacgctgggcagtggggaatgaggctgggaaatgaagacaatactgtaaagaatcttctacgttaggctaagaatgttagcaagttagcaaagcatttagagcagagaaagcttgtcatatatgaacaaaatgtctagaagttcggtgagctgggaaagacatgcagcaagttatgttcagtactcaagtcacaaagtggagataacagcacgttaaatcacaattaagccatcctaggggaccctgctttggcacgaccgccatgttgcatggtggataggtgaaaaggggattgctttatatgtttttacttgagagactgaaggtggaagcctgcttgctctccttgcaccctcaacgtctacactgctactctctttaacagaagcgcatgacagagcatttaggaaaagatatgggcaactgggagcaactgagaaatgaagtaacaaaaaacttaagatacatccatgatggcaaatctaagctataaagaattggtaggattaaggaaaagagaatacggcaatcccagctcaaaaaccttaatacctacccagtgtctccagagcaaaattcaaacgtctaagcatggcgctcaaggtctattataactttcgagaaactttttgtatttcacttcttcctttcttattgcattttaccacaagtattccaataccacatcttttaaaaactgaaacaaaacaaaaaaaatctgaattcccaaatctcatgcttatgctaagctgttttctcggcctaagctgcctttacttgagtcaaaatcctacactaccattcaatacttcatgcatatatcactgcccccaggaaaccttgcctgactacacaaacaataaaaactgtttctcccttcaagtctctacaattttcaaatttctctctatacaaaatgaaaaggcttctctgcatatataggtggccaatcataaccttttggttaatgagttatgaggtggaatctttggaggcacttctggaaaggttttgttgtaataaaggaaaaagttcacagggaaagctctgttttctgccccttttcttcatgtgtgctttagatgctatattagttcattaatttggatggggggtgctatagccatcttggagccccaaagagaaggccaagacaaccagagagattctagtcctgcacactgacatctggagctgcaaagtcacctatcaccaaagcttttagtcacgtgagtttattaaatgtcctcatcgtctaagcccctgggatacagataaaaatgtcctaagtaaacaccgcttactattaatatctttttaattgaatcaactgtgaagatttcccaacatttgagtccattttgaggaggaaaacctggacttctcaatatacctttatcagagagaaacagtcccttgaatctcacaggctgtgtcttcagccctgggctgaggagaacacaggtcagaccccagaaaacaattactctctcatgagaatttctaatctggcccaagaaacgctattcaaggccaagtcataatcttcttatgacttcatctacctttaaaatgtcaagtactgatttccgctgtactttccctgagagcaattattagtttaatgaggaacatgggccaccatctgcatcccaaaacttgtgacacttgagagatattatctccaccaacctggaacctcctacacattaaacacacagaggtcaaacaaaatattctcctcacattttacagtccaagaatcagagctgagctaatgagaccagaaagaatccacaattggccaacagttgttgagcttccaatgcacagggattgaggcaccaagggatagtagacagaagtggacaaagagtggtaggagaattaccaactactgaactgggaaagccatcccaagcactttatctttagtgtttcttctagtttatccaataattctagaatttaaggattaagatatccattttattgaaaagaaactcagagaaactaagcaaattgttcaaaatttcatcgctcggccaaaaggtaaagacaacccaagtgtccatcaacagatgaatggataaataaaatgtaatatacacatacaatggaataccatttagccataaaaaagaatgaagctttgacatatgcctcatcatggatgaagctttaagacactaggctaagtgatagaagccagatacaaaaagatggagtaagtgacttcacttacatgaaacatcttgaatggataaattcataaggaccgaaaatagatgagaagttatcagggttgggaggtgcatggaatggggagttattgcttaatgattgcagagagtttttatttggggtcatgaaaaagtgttggaaatacatggtgttgatggttgcaccacactatgaatgtaattaatgctgctaaattgtacacttaaaaatggttaaaatggcaaattgtatgttacatatattttaccacagtaaaaaaaaaatcacagcactaataaatgtttcaacagcaatttgagacctcactctggctccaaaatccagagtctttctagcaaaccataaaaagattctctaagatttagtgcggtgctgtccaatagaactttctgcaacaatggaaatgtgttacatctgtactgtccaatatggtcaacactagccacacagggctactgagcacttgaaatctggctactgtgtgctgggcaactaatattttaattttatttaattttaattattttaaatgtaaataatagccacatgttgggtagcacaggttaaactgaagagttgaagcataggttccaaaggaggccttatagcaaaatgatgacaccttggtgctaaaaagatcagtctttcaagttaagacttcagcattgaaaaatgtggccccaatgttccaacaattaccagcacaacctccaacctgttttccttgattttagttcacctttacctccaatccatccattacatggagtaacattgccctaatcgcgccatctgctttctgaaaaccccactaaatacgacccttaaatgcatattactaagtgaaagaagccaatctgaaaaggccacacactctatgcatccaactatgtgacattctggaaaaaagaaaaccatgaagacagcaaaaagaccagcgatagcagtgggttagcatgaagggaaggatgaataggcagagcacagaggatttttagggcagcggaaccattctgtatgaataacagtggtgaatacacatttttatacatttgaccacacaacaccaaaagtgaaccccaatataaactatggactttgggtgacaatgatgtgtctatgcaggtttgttaattgtaacaaaagtactactctggtgggaagatgtattgatactgggacaggctatgtgtggtggggaagggcggaaggtactcgggagtataaggaactctctgtacttcctgcttaatctttctataagcctaaaactacccccaaaaatgaaactgtttacaaagaaaacaccattaaaactcattattccatggcagatgaggcccctcatcatctggcctctgcctctcctcctgtctcttttctcattgccccctctccctgtgcatgccatatgccagctccctacactcatcaagctgtttctcactgcaggggctttgcatatgctagtcactctgaattgaatgctgctcacctttctaccagaactgcctctagagctttcaaaacccaaatccccctttttgaatactttcttgagccatgaaaactgagttaactactccctcttgtgtgcacccatgcactgagtaagtatcacagctcatatcattgttttgttactgatctgtcttttctaacagtctctgtgttgcttcaggtaggtcttactccttcccaccagaccttatatgatctggctccaggcaatctcttaagactccatccctcctccttccctccctccagcaacacaggccttgcctgatcctagaacacacagaactccccactgccatagtcttcccaacatctcttccccgtactagaacctactccacagtgagctcaaatgcatcctacagctcaaacctcaacttttaggaaagacttccctgaatccccagactaaaataaatgccctagttataagttatcaaaatactcaacgattcttccttcaaggcatttgccctaaacacatctatactatttataaaagtatttgttcaatatttgtcttctccactatattttaagctccttgtcctgttttttttaatccatgagtccttacccagtgtatatttctttaatatgaacaccttattaaaatgaacaaatttccctttactccaggggtcagggtgggtgcttaataattatttgtgaaatgactgtatttcatttatatccaagatctaagagagtccctgacagatagtgaatagtcagcaaattcagtatttgttgaacaaacaagtgaatggaaagttcagaaatcttggcacaaatgaaatattcaactcctttatggtaaaaatgattcaaacccatattcagagtttcagactgaagaggctgctgcaagtgaggacaaaaataatactatgtgtgtgataacaacatttattttcatttacctagtattttcaagcatgccctcctaccttactctttcagtaacgctgtgtgctggataatacaaacccacttctagaaaagggcaatggagtgcagagagaggacatggctcgccacatgtaatgtactgagctagtggacaaccagacaccaggctgcttagctcccaggcaaaggcagaaggtgggagtggaggctgaggggctgccaggacagaaaagcaaaacaagtcctcaagattcctgggtaccagagccggatggggagagacagaatggactctgattacaatctgaggaggattcatctgctgaaagagagttgattggattgtgctgtgatgccagagtctgtcggcaatcaaacaccctctggctacctctgagcatctggaattggaaagctggaggcagaggccggcttgcagctgggggccatgctgggggacatgggagcagctcagcttcaggctgcagtaaagtggtcaatggcatgcttgtccattccaagcacttgctaatgaaaaatgtttcccccagagaacccagagaaggggagcagcctacactggagatcaggggacagagggaaatggaaatattccttacaattgcagagtgtgccggtgcttacaaacatttaacttatgctatcactagatcctcccccaaaccctactgaattcattgccgtcatccccattttgtctatgcacaaatcccaagttagtagaaaggaaatgtctcactcaaagatacaaggtataagtagtagagccaagatgagaatgccaagtatgtctgattctctattaacaactttcttgtaattataatccaaagcaaaagtcttcatcataaagtcaaaatcttaaaatatgcagggggttagacttttccagggagataaatatgcatctcgattcttcttggacacctactgtgtgctggtagatatgccacatgggccatgacatatgtggtgagattattatcccatgtttgatacgatgaaattaagtgagaatctgagaaatgaaatcatttactgcaagtggcatggccatcaattaaaatcagaccaaattctttagatttcactttgagaactgaggagcaagagcagtgcaggaacatagcttctttaccctctctcaagaagtatgccagcactggctctacagtaaaacagtgatatcttttctgttcaatctgatcttcaattttaatgcgcttccatgtaaaatacgggtgcttaaaatataaaaaagaaaattagagtatgtcaaaaatggttaggaaaggggaatttagagaacaaatgaaggaaggtaaaaaaaatactggaaaacaatctctcttcataccatctcaggaaagataaagaattgagtatgggccaagtgcagtggctcacgcctgtaatctcagcatttgggaggctgaggtgggtgaatcacttgaggtcaggagctcaagaccagcctggccaacatggtgaaaccctgtctctactaaaaatacaaaaattagccgggtctggtgggcgcatgcctgtaatgccagctacttgggaggtggaggcaagagaatcacttgaacccgggaagcggaggttgcagtgagccgacatcatgccactgcactccagcctaggtgacacagcaatactccatctcaaaataaaacaaaaaaagaattgaatatgaagcatgtgctaccaaggctgacttacccatcaggtacagtgtccagggctcatagtcctttcaggagccaacagaaatgttttaatttttcttaaaactacatgcaaatttaaaaatgtatttttaagtcaaaagaatttttaatataaatatgaatataaacatctttgacacaattttacaatattttaaattaatcataataatttcgtaatgtttttattaaggaaggatccacaaaggtaaaggtgcctaggcttgcaaaagtcacacagtgaacctgcattatgactttgagattatcaccgtggccactgagtgtggagcacaaatgaactaatgaggattcacagagttgaggaagagtgttttcagctatgttctgatgaacatttgaatggagtttccatgggcacagcaggttcagagtgttaccaagagaattggaaatactcctggatgcaggtgagcatttctcccttagccaggccaagcagagaaggtggaattaaagtcacctttagtgttatcattttctctatctcaagagtttattatggatccttggaaccacaggagattggaattaatgtctagtcttgagttaagaatgttatatcatgcctaacttaaatcctgcctattttgactagagtctttaattttgcttttttaaagaatgaaaatttacaaacgttacttctcctgtaattgctgtgaggatttacttgcaataaggtcctcttggaagtctgggtacctaaccctttggagggatgaacagagtacctgaatggtgataagaaggcaaagattgtagaaacagctaaatcataaatttttgtgacgtgggcaagtcacttctcttttttggtcttagttttcactacctgaaaaagtcaagttatttgtatatgtaaagttgaagtttcttttaatactgaacacgtgggaaatcacagatggtcctatcccagaccccgatatggtaaagtcagtgatataatgaggatcgatcatacttagcgtttaagaagccttctagtttcctcaaaatccaggatatgcctattagtttccctacaggaagcatcattcctaagaatttgcagagggagagaaagtaaaggtcagacaggttaggtaatacatatgcatacatgtgcagacacacacacacacacacacacacacacacacacatacacatccacatccacacacatacccaaggccacaaagcaaatctggggtattgtcagtttcaatctctggcaacaggaaaaggtgagggtgtggctccatcccctgaatgagtgtaacattacaaataccttagtcctaaggttgcaaactctgattttgggcctgatagcacaatgagaaatcccatttccttcccaatcatttgaatgcgaaaggggccagcattaaactgggggcaattgtctttacatcaccctgggcaccatttctaatcacagacttgtcgaccaccagcctcttgtggcacctagatggagtgcggaaattatcatgtaatttacaacaggcagtgcctgaaagtgactttctcagcatctgctctctagtagtcccaagagcagagaaacgaagaaagttcatgggctgctggagaaatgcaatctcctccagttgcatccaactgttcaacagcctccctccaaacccctcaaacagatcccttacctctgcttctctcattctgtcgttcctctccccatccctgctgcttgaagttctattcatccttgagaacttcccttcatatatcccacctttctgcaaaggcctacccaaccaaactcacctctcactagcttcttcctgaaacgttgatctccaacatcggtgaatggtgggaggttaagcaaggtttaaatttgatctaaatataattcctctaagagtaaacctggatggactctcaggtccctcagagcccttttctctgtgcaaaacaatgcatagattcaacataaaacagtgtctaatgtgaaaaggatcaaacttgtattctggacaattccattccagtcctctttcctgttctgtaccttcctaaacccgtgctcttgagcaagctgcttcaaactgagaacctcagagtccccatctgtaaaatggaaagtgcttaaaccttaatggttgttttgaggattaacaggaacaacaataaaaaaagattgtagacatgacacaatgtaaatgcaaggaataattatggttatccctccaataggaacaactgatgtggcaagtaaagtaacaaataaacttgatattttccatttttggctcaagaaaggcaaaagctgtcttcacgatgtatctgttgcatgctgagataaggctttagtcattctactatgaattaaaagatattgttaagcatcttctatgtacgcatgtaggtcccagcagtagggaaagtaccatcaaaataagatgcaaagaattgtcctttgtgccttaactttgttgaaccatatggttcttgaaatctgtgggtgcctgtctggttatggggagtcttctgatcagtagccagcacagtgtagatgtcattctaatgtcgtctatacattgaggaaagaacacaggaattgaggtctttaactatcagagacagggggaaggagtggagtcagggattgcagattcaactgtgacatggccactcagctgtggtgtgagcctgcatcagtaactgtacttttctgagcctctgtttccctgaaagtagggaaagagagaaatgatgactagatcaagcaataataagtggatgaagaaaacatatagaggcaggagttaagaagtcagatggcggtgaacatcggcttttctcagaaggaataaacccaagaataagagaaagtagatgcaagcccgttggctttgactggttgctaaatataaagtagtagaagccaatgaagatcttattgactctgacccctagtgtgtgtgtgcagctgtccggcacatagagattcttggattacactctgaggttaggactgtcttggtttcattcttccatgtaactgtcaaacatttgctgaatatgtttggctctgtgctcggcaaacttactggaaaaataagaggaaaacaagaatgtcacaatccctgctatcaaagagcttatggtttagtgggtaatacaggcaattaaataggtaatgagggtgaagtgtaatgtggaaatcaagaaagagtccagggaatatgggagtatacaacagcaggtgtctaaccgagctggtagtcagagagggcctctcattttaaatgttatatggtgtgagaatttaaggacaaacagaagagatccaggcaaaaaagtggaaactataccaaagcaagaaaagagcaagtgcgctggggatatggagatgagcaggggataattcccaccctcgtggagctgctggtctaatggagagagtattgaacaaacagccatcctaataacatatcgtatgagctgtgcagataaccagaattgatgaggtttctttccaagttcatgactccatggtgagcatgctatgttctgagggtcactggaactgagcagccaacctgatttcaaggcctggctttactagtggcactctgtgtgactatggacaaggaccttcccctctctacccccagtctctccatctgtaaaatgaggtacttatattagataactgtgcatatacttttgtactctaaaaatctgtgctttagaatgacttagcatttttctggatcccttctttgcttctaatagaaacagtttttttcccccttccacattatgcccctttatgtagaattggtgacattatttatttctcatatcctcaggacttaaatccccgaattattctaaatcttgcccagacctgacaccacaaataaattctcaatctcagggggattgagacaaatgggggcttgccactcctgtgacctccatcagggatttggctccaacattctactcaaggaaaatgttgcaccaagtcaggctagaggggaaaggagaacattttttaaaaaacagccgagcatttgtgaaaagacaaaagaagtggctttcccctggatgcacatccaagacctccagcagattggagagcatttaattttgagtctttgcttcttgttctcaaaaggaaacaggattcacctaagtgggaggcggccagcatagcaagtcgctcccatgcatggggtcgtgtagggccgacttggaatcctagctccaactccaccctcattaaattctgtgtgacctggacaagtcatttcattgtctcatagactcagtttccccagctgtaaagtaaagataccatcaccacctcagggagttgctgtaagagtaaaacaaaactgcataggttgaatacctactacagggttgcaacacattgagtaatgaaaagcaggcaaactaaaccagaatgagggctctgcagaaagctggcaggaaatgtcaatggcgctcagctcactggtgccagatatctcccatggggcagttccctggaccctaaaaaggcaagggaaaatatatagtctaatagaaagcatatgagcattggaatctaactgttgagtgtaaattttatctataccaatctctaggacccttctcactcctctaaacctcagcttcctcatatataaaaaatagtacctatctaggttgttttgaggatttaaaaatatatatattgcatatcaagttcttaatatgatacccagcagataacatgtacacagtgaatgatggctaagatttaggatcaccctgcattttgtttgattcctatcacatgcttggttttgtttgtttgttttgttttgctttgagatggagtttcattcttgtcacccaaggctggagtgcagtagcgcaatctctgctcactgcaacctccacctcctgggttcaggtgattctcctgccttagcctcccaagtggctggtattacaggcatgcaccaacaggtccagctaattttgaagttttaatagagacggggttttgccatgttggccaggctggtctcaaactcctgatctcaggtgatataactaccttggcctcccaaagtgctgggattacgagcgtgagccactgtgcccagcctttttgtgtgtgtgctttgagacagttcccatgcttgttatcttccatttgctctgtcccatactaaaccattttctgcagtgctcgttgcccccggaaaaaatcaaaacctgtgtcatccaagttatcttgcctgcagctttcagttgggttctgctaaagagaggccctggtggtagatcagtgggcaggtaagggagagataggtcagggtatttattatcctccctccatccctgctgacctgtggcctcaacagtgggtgagggggtcctatggccagtctctataagggagttcctctttctcaaatcaatgttccctttcctggctccttcaggatggcaagagcttcctcttgtaatgagaagtctgattccttgttttgatgtttgactataaacagcttttaagtctcaccacctccctcttcaccaccaccaccactgtgccccatatctgggcaatctggtaggaatgactggacgctccctcctttggtgttggctgaggattctaaccatgaaagtcctgcctgagtgtggaaactctcactctggccccactctcgtgccacagtaaaaacccacaccagtctcttttcctggctctctagtcattctggaattgtgtgagaagcctgctctgctccctagaaatttcacttatataactaataagcctcttcctaccctcttggtgtgtgtgtaccatcattagtttcaatatccaaaccaaatttggggtggggatctctcctgcttttacaatgaccaaaatacccctgatgccagcctgcaatgcctcattgccccgggtccattcccttagccctgcccacacccttcattaaatgctctactgttacctcttctgagtatgttcagaagggagctatctgtttcctgccaggaccctgactgatgtaacaccgaaggtccatgtgtacgttcattcatgaagcatctgttaatcacctacttatacaagttatactgtgtctgaggggagtgtgtagtgaaggaaggctttacagaaagagaaataaaacaaatactttacacacattatctcatttcgttctctcaacagccctgcaaattggcatcattagtcccattctataagtaaaacaaagcgcagaagaaatatgaaaattgttcaaggtaacacagcatctttatggtggaagggaggtaagaatctaggactaactccattctaacctcccgcctccctttatggagacacaagcacccgtgattgcagtacagaggagaacatgtatgaaatgccagcagaacatgctgtgaaagatcagcagatagagaggacatttttggttacagttaagggcctcagagaaggtggcatatttaataggcttaaaagtatgggtaggatttgaagatacagagattaggaggagtcaaaaggggataaggctacataaaacaggtctgttatcagtgcccaggacatgatgtagagaggtgggacaggtaagttgaaccttggcattaaagacctcgtatcaccagccatctctccttatttcatgcagtcatgcctcagccaccggcagacatctatcttttctcttgacctactaggattgtgtagtgcataggaattctttatggaatctcagtttcctcatccgcaagcgtgggctgttttgttttgtatccacctgtctaaacgtggattaaatccattagtagcatgatagtttggaatggttcctaatagttaacattttctgagtcatattcacagtaactgacatcttgttttctctatccccctctactagcctttaagccatgtgattgaagatggcatgacccacatatattccctctacaacaccccacagagtaggcatccaataatttcagaagagtaaattcatgtagtccagcttccccctctgataacttagaaaattcaagaccagggagatagtgacttgttcaaggtcttagccaagccgattaatatctctacccaagcatcaacccaataaagaccaactcttagaactcatcatgaagggcttgtttttcaagcattgggctacattttgccaacctctgtttgccactgcagatgtaaggttaaagaaagaaatgggccaggtgagtctttctgtgagcaaagaaaaatatgagccttttgaacttgcctgaattatctgacaagtttaatcaagtatgaaataaaaagcaggcatgatttacttagttttccaaaatgcagttgatgaggtaccccacgaaagattattgaggaagataaatagctgaagagcggggtttaaaatgaagttgtggcataggaggcaagtgaggctcaggactcaaaggtctggcagctatagaaatgaagagatgctagtttataaccctgagaaaagcatcctatgcttatagaagcatctgggcttaaacttaagttacgaagtctatcaggaaccatggacgtccacactgcattctataatgagacacaataaataagaaaagaggcacattaagtaaataaaaaagaaaagagccaggcatggtggctcatgcctgtaatcccagcactttggaaggccaaggtgggtggatcacttgagctcaggagtttgagactagcctaggcaacatagtgagactccatctctacaacacacacacacacacacacacacacacacacacacacacacacacacaaaatcagccatgcattatggcatgcacccgtagttccagctactcaggaggctgggaaaggattgcttgaaccctggaggtagaggttgcagtaagccaacatcacttcactgcactccagcctgggcactggagcaaaaccctgtctcagacaaaaacaaacaaacaaaaacaaaaacaacaaaaaaaagaaaaaatgaagggaaggaaggaaggaaggaaggaaaaagaaagcaagaaagaaagagagagagaaacagagagaaaaaaagacagaaagaaagaaagaaatagaaagaaaaagaaagaaagaaaaagaaagaaagaaagaaagaaagagagaaaagaaaagaaaagagaaagaaagaaagaattagagtatgcttcaattacaacttccacatctcaggtttcactcatgctatatgttcattccaggttggcagggtgtctcagctcgtcattgtctcaaaatgacccaggctgatggggcagacaatatctgaaacattgccaaactccatgtgagagggaaaaaagaaagggctctggagagcccttccttgacaggtaaatgctctggtccatgagtggcattcaccacttccactcacagttatgtgagccatcccagtaaaaatagaccaggaagtgcaacccaagcgtgtacccataaaggagaggaatcagaaatatttgacaaagcaatgctaacagtttggccaacagatcctcccatgaaagtccacaatgttctgatgatgtggcgaggccccaggagcatctgagctttgccaagggtgaaggcagcttgtattggacagtggaaatgcactggcctaggggtttggaggtatcttaggcaggccacttctcttattgctgtttgtaggtgatgctctatgagctccttcccagctctttccaaggagcagattcaccattgcagaatgtgacaagttaacatagcattctgtttgttctgcgctcctgacacattacataactcatcctgatctgccattatccaaggcctctgttcgtttccccttgtaaactccttgagggcagaggccttgtctcactcatcttgcaaaacctagcaccgctgctacatactggaggcactcactgtgtgtttattgaataaatacacagataaagatttccaaaaccgatgactttcaggagtcaagccagtcagctcagtagatgtcccaattaatacactcaatgatcatgctgacaatggcaatgacaagctgacaatgttaatgataaatattaataatttaataagtaatattaaactatatagggcactttccaatgtacagatcccttttacctctattctctcctttgatgctctcatcaaccctgtgtgggaagcagagcagaaattggcatccctgttttatacagaagggaagtgaggtcccaaaaggttaatgggactttctccaagattacccagctcatcaatgtagatctgggacaaaaatttaaatcttttcattccctgaccatgatcttttcataagaaatcccccctctctctaactcctctgagaacacaggaatgagcccttattgtactatgagtacccaatttttcctgcatcttcctgattagactcctgagccatctcatgacctcagtattggtgtctgagctcctgcaccctccaaggctgcccactgtgccgccctgctccagcaactgtagctctctggaaacacctgctctgaaccacaaatagcgtctacttcatcttctcttttttttttctgagacgcagtctcactctgtctcccaggctggagcacggtggcatgatctcatctcactgcaacctccgcctcctgggttcaagtgattctcctgcctcagcctcctgagtagctgggactacaggtgcacaccactacactcagctaatttttgtatttttagtagagacagggtttcaccatgttggtcaggctgatcttgaactcctgaccttgtgatccacctacctcagcctctcaaagttctgggattacaagtgtgagccaccgtacctggccattccatcttctttttcagtgagcactctactaaggacattctcacagcagaatagaggctgtcttacatagacttgctatttccccattttgtgtgctgttttgtggcaacaatagtcaacagaagtgaactacaacaaaaacaaggcatactattgtgcaggattctctcagtgattccttgtaacagcaaggccacccacttcacaggtggcaagcttgaagtctatagcaattaagtgacagaaaagggagtacagtgatgagtggggagcatgagctatggagcaacagccagacctgtgctctcatgctggctctgccacttaccagctctgtgaccatttgctatttactaatacctgtatacttcaaatgcgttttctgtaaagaagggacattttcatgatcctctgggggtcatggtaaagagaagggtgtgtgtgtgtgtgaagcttttgcagaagtccctgctcatggtaaacattgaacatatgagttccttcttcattgtctgccttcccttcagacggtaagctcctaacaggtaaggtgctctgtctgtggtcacagctgcctccctagggtctaatacagttcctgagctaggatggatgctttctaaactcttgtaattattatgtgacttaatcaggtttgcagagatatttatctataaaatcactgaggcttttgcttctcagacatatagaacttggctacctctaacccagtgttatttttagcttcagttagaatcatagaaacctggaggaaggagggactttaggtcagcccctgttcatttgcacgagttacctctgcaatgccctatcttattatcatatgagttctgtacaatatttcactccatggtatggagtatgtgctcttttcacaaacaacttccacttgcagctccttagtttcttgcttgtaaatagaatgccaatcccaggtcccagcctgaccaccagaaaagtgagcttgaatagaagatgatgttctggaagctaacgatccgcaagtcagcagactttaagcagcaactaaggataagggattcaaaaaactagtgtaatgtttatgtagcaattcttcatcacccttgaaaaggcacagcaacaaaaatagcttccagggatctagaagtcttatcaaataggggggttttggaaatataccagtgggtgtgcatgcacatgcgcacacatgtgcatgcacacacacacattcacaatttaatcttatactcaatacaaacaaaagaagttatccattggaacaaaaacacaaaaagaatgttccagaaacattgccatggtattgaaattgaagaaaatgatcatacccattttccattacaaaatctgtatctaattttaaagtttaaagaacaaacgaatctgctgtgtttgagtaggataagcatagaattatactttccatctcccttcttaatttttgcaatgtgtgtaacaggtgagtttttccattatcattgagttaacacacaggggtgagagacagtatcctaatcttgtactgaaaggtgaaggtaaacaactttctttttttctatactattcgtcagaactcccttagtttccaggggaccagaataacaattgtcatgtgctgtttagaagaactgatctgaaaaactcatatataaaaataacatacatttttaacatgttggtttataaatataaaaatcccattatcacaaagccacagttggccaagtccccactgacaaaggattactgtgcctttaacacagtatgaagaacaatcatttataagcttaaggaacgccctgaaccttgattgcaggtgttggcacagaatagttctgcttgaacttaggtcaagtaaaacggggtaaattgatctaaatcatcatttacttaagggaaactaaagtgttgctaatgaagatagaaaatcttacaacaaacacaagataatacttgccaacaaaagcacaggccagcctggattaacaaattctctaagtgtttttccccatcatggctatttgttaaacctggaagagtgctattcaaatgcaaagctcttctacttgttgttaattatattattttctttttctaggcaccagtgatcctgattgctcttggaacctcttgggaaataagcctccatgtaacatgattataatgattcattatatttgggtaggttttgtagcttaaaagtgcttttccatctatttttaatattatcattattaataataatagctaccatttattgtgtgcttttcaggggccaggcaccattcagtgaacagcaaacacagtatctctactctttacgataaccctgcaaggaggttgcaatacccatttcatatggtagaaaactgaggctcctacaggtcaaatagcctgcccaagatcatatagaccctgcctgcctgaccccacaatccaggccatttttgctttaagtatgacatattatatgatcttaaagtcatctgtctactatctattatctgtcattcttttagactaaacactctttgaaggcagaaactatatcctgttcagagtcataatctcactaccaagcacagtccctgggacactgtaggcacttgatgaatacttgctaaaagaataaatgaacacatgagtaagtgagtgaagtcttataggttcttctactgaggcaggaagatcatttggtacttttcctgttaataaactgggatgcagaggctttaacaagagaattgatttccctaagggcacacactgttaagcattagaggaggaaccccatccacacccttctaacttctggtcttttggggattccacaggcccaggttgcctctttattacattaaaaaaaaattcatatttgtcatggcacgctagttaacaagcgatgagcgggaagctacaggttggccctaagtccaggtatattacccacctccctccacactgccacccttctattaaccccacttggaagcccatgaatgattatgaatataaatgtgaaggctcctcctttgaggtagatgagggcggggaaagagaagatggagaacagacaattcagacagccaaattcaatttgagggaatttggttcagtgctttccattaacaacactcaacgaaaaatataattcccaggacaaaagaagaaaagggaaaaaacaacaaaaaacaaaagcaacttttcatcatgcacagtcaatggaaaacaaatcaatcaccctgtttctccctggcccagcaatgcctcggtgaacaccaaaggcacacggcctctaagctgttgttgagtcctcagggtggtactgggagaaagaagtatctgaaaaagaaatagatggccaaaaatgtcatccatgttctagccttcttcaatcttccaaagaacatgttacagtttagaaagcactttacctaattcagtcatctgatactcacaaaacctttttaaagtaggtactattatagctcctattttattaaatataaacaagaaaatgagtcagagtaattaagtaatctgcttaagatcaggcagctaataagtgtccagaaattaaattcaggttcctttaacccccacatgtcaaactcttttttttccccctagagacagagtcttgctctgttggccaggctggagtgcagtgatgaaatcatagctctctcaatgcagcctcacactcctgagatcaagtcatcctcccacctctgcctcctaagtagctgggatacaggcatgagccacaactcctggcctaagcttaaattctacattatcaaatgcccccaacaatcccaagggagggcaaaaactaaacccagttggatgtccctacattattaaataaccacaacaatctgaagggaaggccaagactaaatccagttggatgtccctaccttatcaaatacccccaacagtcccaaagaagggccaaaattaaacccagctggatgtccctacttcatcatatacccaaaacaatcccaacagagggccaagactaaacctagctggatgtccctacattatcaaatacccataacaatcctaagggagggccaagagtaaacccagctggatgtccctacattatcaaatacccataacaatcccgagggaaggccaagactaaatccagttggacattccgcacacaactggggatttttcattccaagtcaaactcatcccaacataaaaactaaaagggtctatatatttttaatatggtaacatccctccctgccttgcctccctaatccaagcaaaacttgaacaaaaatagcaaggcctcaaattctcgtagtgctattcctgtaaagtgtcctttcacctgctgacagccagttggggagcaatgtttccaaggaatgtttccaaggaagttaaaaacacaaacttaggagctggataacgtggatttgaatcccatcttccccccaatagttgtgtgaccttcagcaaggctcagaatctccttgtgcctcaatttcttgatctgtaaagtcagaatagagtcacatctcatctcatagggttgtcgtgaggattaataatacctgaagcacttagtgtctgaaagatggaaagcatttcataaaattgttattattgctaggtgtcaaagcactgatggatcatcagtggatttaggatgctaaattaaggaggctcctgtagagtgtaattttctcattctacagaggaaataactgagactcagagagaagaaaccccacccgccacctttcacacaggttcattcagagagccagtgatgatctcctacacccaggcagggctcttcgtctgccttgcatacctgtctcaaagttcttgcatttcaggagcattcacccgaaaggagcttcccttctctcatttgtgagaagtggtagactggtcctaactgagtagggtttgcagggaatctttaacactacttggcaaagtagatactgatatttctagtgccttgttgagcatcctcaatatagaagctgtaagaggcccgactgcagtccccgaggccagtgtgtgcacattagcatccagtcaatgcaatgactcaaagggtgattatgtccttggcacattagccctgcacctgcctcttcctctctctttccaatgccctttgatcatttactggctcattgaatcttcccccagagggtgaagaaggaagaaggagcctaagtcaatgatcagtcagatattggtactagttagcaagtcttaccaaaccttctgatgcaatggctagatctgcactcctggaccccattcatatggccatttgagaggtgagggatgtttccataatcacaagctagaatcctgaattggaaggcttcaaatgctaatgctgctgcctattagctatgtatatttaggtaactcacttcatctcactgagcctcagtttcctttcatctgcaaactggatataataacagtacgtaattcaaaatgttacaagaattaaatgagatgataaatacaaagcatacaatacaataaaatgcctggcacatagcaggttctgaatacatgatattgaattaattttatctattattaatagatttaaaaatttttaaatatgttctggctaatctgtgcaccaaacccttagggtttgcagcttgtcactttttccctgctaacccctggatggtgttggctgcagggaggaatcctttgcaaattcctcaagcagattcttgtttgtaagcacattggaacaaagaggaacaaaataaaaacttggatttggaaccggaatatttctacttgattctcgtggttctaacacttcttagatgtagcatcatgtctggtaagtcactgaacttctctgagactcagttttctcatttctacattggggatgatggtgctccctgatttgccacctgaaagtgagcatggggcaaggttcattgctgtcattcgcatcattgttattagaggaacacactcattattattgagggctaagtatgagccacgcatttaaaatttatctaattttatgcccatactgaaaagtcagtgttaattattccatttacagatgcagaaattatggcttataaacaaactccttaaaagacttctatagatttttgtgatacccatctgcttaaactccgttaagtcttgcttgtgttccactggctgctaagatgctttttaatgacattttattatttgttatttgagaacatgtttatctgtgtgaggtgctcaagccaaggaaagggttatctttattttggcttccctggtaccacccagggtgccttgtatttaacagataccagtaaactattatccattgtagtagaaaacttcaaggtcaaactaagggatgcagaccagtgaaatatgctcttgtaatgtgaggaacatccattcagaaaggcctcttttgaaggggaaatgtgattatagagatgcagagattatcaagagttcatagaaggaacccaggtgggaaatcagacagcaaactggaacatattcctgccttcataatgagggagaaaggaaattagtgatgattctaaggtggcaaaggtcctgatctcatcttttatgatctgtattttgccagaaaaagaaaagaaaagaaatgtggacaattaggaagtaattaagatctcacagaagtatctacgacagaaagcagttaaggaaatacttagggatttgggggaaaacacaaattagcaggttggacagcacatatcctaacatgttccagggaagagctaatagagttactgaagcacttaatgattatttctgagaagtcactgaagaacagcagcagaacatacgcttaaattttttacaacatcaaatgtcatattgatcttttagacagaaggggaaaaatacatgaaatagaagctttaagaatgaagaaagtgggggaaatacttgcaactgttatgtggcagatattttcagatatagcaacccattcaatcgtccacttgtaagccagccctggattcttcccattttccagactaggaagcagggcttaggatggggaagcaaatcatccaagacagccactaatcattgctcgagctgggattcaccccagtctctgcctcatgctggcaggacccatgtcttgccatttttattgctcttctataacaaggattaacaaattggacacaacccaggaaaacaaaagaattatgaggctgcataagggcagggttaaaaaaaaaaaaaaaaaaaaaaaagcacagatcgcagcccgcaaacatgagagcttttcaatagaattacaaagacaatggatgaaaagatcacaagatgacttaatctggaccacaataactcaaaaatgtttctcacaaaattaattcaaatggactgggagaggctgcatagctgcaaggcttgaaaattaactcaaaggcagtaaacaaagaataatgatggaaataattcaaatacaaaagaaggcaccaagtctggtagagctcaaagccccttgcaatgtcattttattaatcctcctggcaaattgacaatgcagcaggactgggagaggtatagtcttgctgaataaagcctcattttgagacctggggttaacagaagtaaggtacaaataagggctagtttctcaccaggagcacctaccaaaggaaaagaggagctgtaggcattgcatgaaggagaaataatccaggttgaccagaagcctgactatctggacaaaccgaatactgtcaacccagaattgaagacccatcatttcagatcctgctcagcttctgtggttccccaccctgtctttttccagttgactcagctaccaagatcatctttagaaccaatccttcttcctctggatctccctaatcccaaatccttacctagactggggtttacttagttagtactagatcaaattccctcccagcacgttcagtttcaacaagaaacatcctcctgtacatgtatgcaccacacactgttagtttgtaaggacagagagatggacaagggaagagtccttggcctgccctctagggctcagtctggagggaaatgtctgggccagagtttgcatggtatattcatttaaccttgcctgaatttgtgtttggaaggtcatcatccttcacaaaagttcaagtttattctccaagggtcaaagagttaacaaataccacagtccagcattcaaaactctgtctctctggcacaaaagcccatgttttctccatttgactacacaaagctcatcaaagccttccacaaccaatgtctgtaccaccagttcacagtcgtaggtcaaggaaaataataacttccacgagcaagcatttattttgtgccaggaattttgtttaacacatgatcttatacagtcctcataaatcctattagagtcatcattaaccacgtattgcacgtgaggaaatggaagttcaagaaggaaaaagtgaaacacagcttgcaagtacagaagcaggagattcaagctcaagtccatctgccctacagactttaagcccaccacttagtgaggatgtgtgtgagtttcccattgctgctgtaacgaatgaccacaaacttagtggcataaaacagtgcaaacagttttgcaggtcggaagtccaaagtgggcttttgtggggcaaaatcaaggtgtcagcagggctgcattcccttctggaggctcttggggatagcccctttccttgtcttttccagctcctagagtttcattccttgtctcctggcaccttcctcccacttcaaagccctcaagtctctctgtatgtctatcttcacatccccctcgatgagtctaatgccactgcctgattcttataaggacacagtgattacatagggcccacctagataatccagtataatcttttcatcccaagatctttaacctaatcacatctacaaagtctctttttccatatggcatagaatattcacaggttagtaaattaggatatggacatctttgggggaccattattgagcccaccacaggatggcagaagcacacttaactgtagtagaaaccctaataagctcattttgctaaagaagacactgaggttcatagaggtaaagtgagtactttgggacatgtgtaagtggcaagataggaatctgaacccaaactagtacaatatcaaactccattttctccccttcccatagtatgtcgcctccaggaaaatgtcagacagataaaccatttggcactttcaaatggataaatggccaattcaaaatgaataatccttatgaatgattttaagacagatttggtgattctctgggttgatgggagtagttgtaggtgatctgccactttgcattttaggaaataccaagaaatatttaggggttagctgaatgttgataagtgtgacaaaaggcaaaatttttccttctcagcagccaggcaaagcaggatttgtgggaggagcgaagcctgagctaaatagactagatatggattcaagctccagatcttctgactgtagtcacaaccaggctgtgtcacatttctgggatcagtttctgaactggaaaatcggggctatgatgttttcttgggaagaaaaaatgagataatgcctgtgtggtgtccaacattgcatctagcacatcataggagctcaataaatggtaggcatttttattttctctcctctgtcctgatttcaggttttagagtaagaaacaaagacatctggcctttgtttgaagacagaccgctagctgtgcaactaatctttaaaaaaaaacaaccactcccttctcttgcctatgctcaaggtacagctgagagcttagaaactccaggcagacaaacgaaggaaggcaggtggataaaggaaaagctcagccatccatcagaccaagaggggataaatgcaatgcattattcagggagttcagtggtgggcctctgctaggaatggatgagggagttggagaggtcttttgaactcctcgggatttggccgaaagccgagagaggccagatgccacagcacctattagtcagctgttggccagcccttggcgatccactgggactgtttcaggaagcccagggctctgaatagggcaggaggttaaccaagccacctccccattctgcaaagccttttctaaaaccctgttttggaagctatgcaggcactaaactgcaggaaaccaggcagagaaggcccttggggcaggacccgcctcacctgtaaacagaattgctaatggcttgcagagggtggtttgactggtgatggacagcatcctgaacccataaacgtcccatgcatttgttgccatatctaaaattacaccttgactctctgagtgtaaattaggatcgctttttaagagggcatttcagcaatatctatgaaaattaaaaagtccatatttttgacctcataatactgctgctgagtaacttacagaaatgcacatggcaagaagctatatataaatatatatatataatatatacacaaaaaagttcactgtagcatacttttaataacataaatgtccatcaataggaaataaattatagtaatcaatactacagaataatgtcattacaaataatgatatggatccaaatattctaatgttgaaagatttccaatcattttaaagtaaaaaacaaagatacacatacaagtgtcaaaataatagcgcaatgattctgtattggaggaaatgacagatgcatatttggatttatccatacatgtggctataattaaagagaaaaataagtgagaagaataaacacccgttaccagtgatagtctctgggtaggaaagtgagaaaggggatgcagaatggaactatcactttctaccccacatgattttgttgcgtttatatttttataaaaggaatggctttatatgttaattctgtaattttgaaaagtataaattaaacaatgaaattcatttccacaggtgatgagaacaacaaaaggcttggcaggtaggttcacatcatcatttctcagatgggagagcagacaagacagaagaagagacctgtctaacatcacagagtggggtcagggagtagatccagggctcctggtacctagtccagagtgtttccaccatcttcaaggtctagatctttgggtgtccatgttatggaggcagatttccactggatagcaggggaactttatatgacacaatacctgggaataatgtgttgtggtggtcttgttcaggatgctatctctgccactggctggcctgtggcctcggccaagttgcttttccacactgagcctttgactccttatttgcagtatgaagaaaacaccattctcagggagacattacgaacatcagttgttccctttcctccttttcaacaaacacatatccactgcccccttcttgggaaaaggtgggagaaaaccagactgagtgtgtcttaaaactaggggttcaagtttctgctctgtccttgacccaccaaggcagtgtttaagaacctctggaaaccttctccacactttatccctcccaaattctctgaatacctttgggtccttcctactcatcaaggggaaaagtaaatatgtcttagatatgttttagatctgtgtccccacccgaatctcttcaactgtaatcctcagtgttggaggtggggcctagtgggaagtgattggattctggggacggatccttcatgaatggtttagcaccatccccttggtgctgttctagggatagcgagttcttacaagatctggttgtttaaaagtatgcaccacctcctcctttgctctctcttgctcctactcctgccgtgtgagacgtcatgctccctctttgccttccaccatgattggaagcttctagaggactcctcagaagcagaagctgctatatttcctgtaaagcatgcagaactgtaagacaattaaacctcttttatttataaattacccagcctttggggtacttctttatatccatttgaggacagactaatgcagtctttgagtcaaactgctgtcatcagaaataaagagtttgatatgcttccccaccacgacagtctagagccgggcgtaggcagcgaaaaaggcttgtgaggcaagacgccccttgcaggagcaaagggacccggtgttcatttcggctggtgaggagagttactaaactaccacccactgactcagggagaactagccccaggtttatgtagaagaggcagccttgacaaggtgaagtgatggtgactggctggctccaaaaatctctctccagtcatcctgccttagatgactggaactccacccttaatccttccagttaagccttcgaaggcctccattagcagtgtaaatgtttctcttgggaggaataataaaatgtaattgaagtaaacaaacatttactgagtttgcttcaaaccaggcacttgtgagccatggcagggtgtccaaggatgaataagatgctatcctgtcctccaggagcatgtagatcattagaagcactgagatgtatgccaaattacttaaaacgagagagaaaattcaaaagaagataaaataagaagaaagttccataattgttctctcatctatatattttatcagagctggatgataggatttatcaccttggggaatttccattaacatggctgaaaagtttgtactttatttggaatataatagatagctatggatattttctgggtgaaggggagggagtggcatattttttaaaatagtactttacaaagatcaatctgacaactctgtagaagatggataagaagaatcaaggcaagaatcaggagaaaaacatgagacactaatgtgaaaggttttagagaacgagaaacaacaggatgtgagaggatatagcaggagaaggtgggctctgaaaaagatgaagggatccatttatgtttttactccacagtacttacttcaggcaaggcaccgtgctggaatctgaaaatacaatagaagggttctaccttccttgagcttagagttgagtgtggtggtcacatagtaatcgagcatcataaaaacaaacgtataactcacaaagcatgataagttttctggagaaagagatcacaggatgctataaaagaatgatgaccaggccaggcatggtagctcatgcctgtaatcccagcactttgggaggccaaggtgggcaaatcacgaggtcaagagatcaagaccatcctggccgacatggtgaaaccctgtctctactaaaaatacaaaaattagctgggggtggtgttgtgcgcctgcagtcccagctactcgggaggctgaggcaggagaatcacttgaacccaggaggtggaggttgcagtgagctgagatcacaccactgcactccagcctggcaacagagcaagactcaaaaaaaaaaaaaaaaaagataacctgctctggtcaggggtggggctgctgggtacatcttctttgactgaagtgatatatgatgtgggtctaaaggataggtaagcatgaactaggcaaatgaggtaccacttcaccccactagggtaaagacagacattagcaagtgttggtgaggatctggagcaagtggaaacctagtagctgatggaaaggtaacatggtgcagttactttgaaaaaccacttggcagttcctcaaaaacttaaacagaattaccatatacccagcagttccattcttaggtatatacccaaggaaaataaaaacctatgtccatgcaaaacttgtacacaaatgtttatagaggcattattcacgataaccaaaaagtggaagcaatccaaatgtccatcaacagatgcatggataaataaaatgtagtctatccatacagttgataaaaagaaataaagtgctgatagatgtttcaatatggatgaactttgaaaacatttctaggtgaaagaaggtcacaaaagaccacatattgtatgatttcacttatatgaaatgtccagaataggaaaatttgaagagacagaaaatagattggtggttacagcatggggaaaagaggagtgactgctaatggttgtggggtttctttggaggtcatgaaatggtctggaagtggataatggtgatagtggcacaagtgatatggcttggatatttgcctcatccaatatgagatacattccaacatgtatctcatgttgaaatacaacccccagtgttggaggtggggcctggtgggaggtcacagaatcatgggggtggatttctcatgaatggtttagtgccatccacttggtaccaccctcaagatagtgacggagttcttgtgagatatgatcacttaaaagtgtgtggcacctccccattttctctcttgctcctgcttttgccatattaagaagcctgctcttgctttgccttccaccatgagcaaaagctccctgagacctccccagaagcagatgccaccatgcttcctgtacagcctgcagaaccataagccaattaaacctcttttcttataaattacccagtctccagtatttctttatagcaatgtgtgaacagactaatacaacaagttcataattatatgaaaaaccactaaattttacacctttaatagggtgaattttatggtatgtgaattatatcttaagtaaaaagtaaattttaagaaaagaatgaatgaggtagagagggtaaaaataaggatagtgttctggtcacaagaaagtatatgtaaatgaccaagggagagaagatatggttcacagggagaatagaggtcaaggtcaatgtggctggagtgctgggagcaagagagagtgatagcacttaagtctagagctataggcagggcagatcatgagtaccctttaggcttggtttttgtcctcagaataatgggatgctgatggggaattctatgcaaggtaataacaattctattacttgggctggtcaacatgacttggagggagtcaagaaagtgtagagggtgcccagttgtaggagtccaagtgagaaaagcgaggtcaagagtgggtgatggggttggcatgtgtgtgcatggagggaacagagtatgactaggtgtggaggactagcattattctgagttcaagagccaggagggacagcaggtttgggaaaacagaacaagtctgatctgcagagacatttattttgcacctaatatgtgccagagactgaacaaggcattttatatccatgtttctttttatgctcacaacaaaccaatgaggttgattattcacactgtttaggacgggaaattaaagctcggggagactaacttgcccaaatgcacagaggtggtaggtggcagcatagggagttaaatccaggcttgatgccaaagttctttgcatctttgctctacactagaatgctcctaggccagggatggtaaatgactttcaacacacacccaactcgaatctattagtagtgactgctttggagcactgggttaagaccagttctgagctcaagcccaggcccagcaggaaaatagaccacgattaatcaggaatgaatgccgtgagcacagagagaggcagtggtggggaaagtgaaccctatttgccattcctgctgtacgagttcaaaggaggaaaacataatatctaggcaaaggactaaaaatggccacgtgtgaaccatccatatacacaatagatgactctcaaaaatattagactgagaaaagatgtcagaaacaaaagaatgaatactatatccagaaggcagaacttttttagtgaagggccagacagtaaatatattaggctttggggaccagagagtctctgtcactactcaactctgccaatatagagtaaaagcaaccgcagacaatacgtaaacaaataagcgtggctgtgttcaaataaaactatttttaaacactgaatctgaaatttcttataataattatgggtcacaaaatatcattcttcttttgattttctttctaaccatttacaaatgtaaacaccattctttgctcacaggacatacaaagaggcaatgagccatattttgctcacaggccatagtttgctgactcctgtactgtttgtatccatttatagcaggtcaaaaatagacaaaattaatagttagagatatcagaccagtgggtgcctacaaactgactgactggaaggaattactcaggaacttgctggggtgatagaaatgttctcagttacatgaatatatacatttgtcaaaactcactgaaatgtgcacttgagtgtttacatttcattgcatgcaaattcaacttcaatttaaaaagtgtgttgctttgaactgtaacacttgtgggggctgggggtggggagaatggctgcctggaagagatttcatttgatgaacttgaagaatgaattcagcctccaaagtcaggagaaatatattgaaggcgagtagaggtaaaattcaatcagggctcaaatgctaacagaaagtggaaaaaatatatatatttaacaagaagccatgaaagtataccccaacccacatgcctcattgtccaaaagctccagctcagaaataattgctttgcacaataatttggagatgcagtctgggagctgatacaaatggagccgggtgcaatttggggagatttgttacgctcagctcccttctatcaattccagctgctcagatgttcctaacctgttgcttggcatattgtaacaatggcttttatttactgcacttccattaaatgatgaaatccacgaacaggggctcacatggcagaaaatcaccatttacttctccacttatcttgtgtcagcagccaagatcttcatctcggctcctgggatctggcttcagcagccagctgcagtgctacctgggaatatcggtagagcagctcaaatatgggcggtgggactgagctgctgggcggggttgcgtgactgcaaatcatagtccttggaaggtgagcaggcagtgtggccatataggattatgctgggttgccaaagaaagagatggatgtacactcaggttttacccagaactcaaggtatcttgggaagttttgggaaagtgaggtggttgattaggagaaatattggatgggatgttgattcaaagacaaaagcgaaacccaagataaccttcacctgagtgaatcactggtccttttacagtataacacatctcggcctaaccaagccaggagatcttcactccaatgttagttttgctaccagataaatgactagagatgtgatacgagtcccttcccacctctgcactttgctctcccttctgtgaaaagaagttaaactgagtaatctatttcagctctaatgttcttttaatccaaccttggttctcccactaacttgataagtaactctcagcaagtcatttcctatgggccatggcttccacatgatacactgagagggttgactgtgacaatcttgaaaggccctcccaggtttagagctctctgatctcatctgctaagactcagaacatttatctcgttgattttgtcaaattgtactttggggttagagttgagtatacatcattcttcccaatcctacttcaatccctagcaaagggaatgggtggatagatgggtgaatggatgttggatgaaggggtggaagggaggataggtggatggcaaatagatgaatcagtggtaggatgatcagatggataaatggataaaagggagtttgggaaaactggagaacagataaatgggatgatggaaatccacaacaaatacctcagtatttcctttcctgtccatagttcagttccagtgtactgagtacccataatgatgaactccactatatatagtatcgaagtttttgatgctttctggattcttcacttcaggaaaaaaagaatcataacattctttttatttcaaagtatgcacatgaattataagtacacatcatgcctattaatatattaactgtgaaaggaacataagggaatatgcctcgaactcctggcctcaagtgatcttcccacctcagtctcccacagtggtaggattataggcataaaccactgtgcccagccataagggaatagattatcccttcacctactgggaaccataactcaaactcaggaaaccatacagtgttaaaaaataaaataatttttaactgtttctagagtatgtggtccacccaataatcattgaatatggattttagacagagagagatctgtgagaacaaggggaggcaaggggaggggaaggctaggtggaaaagatttcccagagaagagccttgaaagatgggaatgaaacaggcagtcaggcaagggatgagtacagacaagagtgaggggatgcaggagtaggaggataggaaacattgacaactgcttgatcaagaccatggggtggcatggttgggtaaggactgttcagctcaagcaagcatgcacaaatctctaggcttctgtgtgcccctaggaacgacagagggaagcagggaaaaggaggggaggaaagagaaaaagaaaggagcaagagagaggatatggaaagagtgataaaaagggacaaaaaggaaaaaggagagctaaactgagacaaaagaagagagagaaaggagtaaaaaattctctgcacctaggagttatatttcatgatcaaaagaggatgaagctgggggtgaatttctggtggcagcagggaatgcccaggaagctttggggccagccccaaaggggcaatggtgggggatgataatagatgaaggggatatggtaccttgccaggaaggcccagtgctcaggcaagtggggtccctggaaccctgtccctttctccactgccagctctaagttgctaaggttaccttcttaactgcctaattagagaagctgtcactctttgacaaagatcaggaggaaaggaggggaaaaaaaaaagcagacatttcatactcagacaagaagaaaataataaagccagtcccactggctttcacatagagtttcatagaaactctgccagcagtcaaagaagactatatctttatgaggaccaccctctgttactagtttggagagaactggaaatgcaccgctattcgcagttaacatggagcagctgacagcctccaggttaaatggagtggaagacatgcgagtcaggaagacatggatatgtacccattctgctgccatggtctgacaagtctcagggacctaggaacatggtgctcttcttagccagcaggagctaacctcagctgatcagccttaatacacctcaggagccaccattctagggccaacatttcagggaccaggatggaccacgagctgtctttggactgcagttctgggaaggagagctgaaaaagacatgggaggtgaggtggagctggaaaggggcaggtgcaggaagcaggaggtaagttctgtaaggtcctaggacggcaaggtcccaggtgaatgcctccctctctgagggcagagtgcatgccactctggaatgccagctcctcagccccttgggtgtcactcacccttccggactatgaagacccacatgtgctgcagcaccctccttggctaagctcctgctattttcctcctcctacacccacagagcttactactttctccctaggagaaagaagagcaacactttgtgttgtaaaagaaagcccattttcactaactccattactctatgcaagaatgggagaagcagaacagcagtgggttaggggccagtcctgccaccaacaccctctgggaccctgggaaggtcccttgacctctctaggcctcacagtctacaccctgttgatctcctggggttggctgtggattaaacaggagaataggaaagttcttcttaccaagaaaatgagcaacacaggggcttgtatctatatactattcagagattcatccccagcttctagctgagcacctggtatacagaaggtgctcagtatatcctcactgaattgaaacaataatttaagtacactatattctgtatttatttcttccttcaacaaatatctttttaatacaaaataaagacataattcctatcttcaatgagttttcagtgagtgaatgtagaaaagacaaacatcaaatagaaacaaatatataattaaaatctgtgattaagtgctgccaatagcaggaacttatatataaaacagggagactggctctaactaagaagtcagagaaggcttctctgagagagtgacattaacttagaatctgaaaaatgagcaggagtcagtcaggcaaaaaggggtagaggcaagatgtttccaggaactagaaacagcctgtgcaaaggccaagaggcagaagtgggtctgttacattagtgggaagataagatcagcagagatggaaaagcaaagaatcacagggagaatggcaggatacgaggctggagataaaaacagagcttgaaccagaagatccacaggcttcctagcatcattcccctaaggcaaatcctctttgtttctggagagaaatgcggagtcctgacttctggacgtgggttgtggcatgcagagcaggccacaagaaagtcatcacttttgccaggcacataaagattatgaaatcctaaaactacttccatgatcaccctcacctggtctttatagagcccttgatttgatgctctgttttgctgcaaaggctagagctgaaaggggccctggagatcatagagcctagtggtatctcactgtacttcacaaagctcaagaaccacttcagaaaggggaagagaaggcctacaaggaagggctttgggccccttcacccttccctcagccagagaagttcagctttgctctagtttttacagcactcttcacagtggagccatccaagattccatttgaagaaaggctttgatgacaaaatagggattttgaaaaccactaccattgtgcaaatgagaactctgaggtcctaatgagcacatgtcttgctttttctacccaacaatattttagtattgattcctagacccacctttcaaaatctacctcttctccatttatgtatatcccagacggaacatcaatccaggtatcatcttcttccctagatgagacatatatatcaggccaccctgggctaatgagactctcccaagaattctgaattccggtgaggtcatgggagtgaggaaaggatgacagacacttggatctccttcatcctagtgggagtgctctgatgagactgtgtgctggttattgctcccaagatccccagagcaagctccttcagcaattctatccttccatgagccatcccaaatagaaatatttggatatttcttaaataaacagagttggcttctattggttgcagaccaactgatagaccctgtaatctatggatggcttggttagggtgctcacagagttgggagtgtagccaagattagaagtcagagctcttcaaccacagcctgtgacggcctgggctggtgactatttgcaacctcatgttagctgggtccttaatccctagaattctgccttgtcttcccagcctctttccccagagtctcatgaagagtaaaattatatcctttctatatcctccaacagaattcacaggctatcttgcccttggggtccttctttataaatatgacatcagtcactcctcattgaccataaaataatttattcaatgtgcaaagaaacaagtacagatattatgccaggatctggatctcaagccaaacagaaacaagatgaatgtttaactaatccttactgtgctactccaatagtatgcgtgtgcctttcacttcaacctgagcaaggattaaagaaatcatttgcaatataccctgcttcagaaagcacctgtgaatgtcctgggtctacatcactcttccctttgctcacaatccaagcaggttaatttcctatatgaaagaagctgcaaagggggtgggcaagaggggagaaagggcttttggtttttcttctttaagcctattgactagagctgcttccaacagtagcagaagttgctcccaaggcatttgaaggagatgggaacacacaaacctaattgcattacactgcagcttgaccaagcgatcactaacttgattgcagagaaaggaaatgaaaatgacagagacaaattcaactcaaccgttctcttacttaaactcaggactcaggccaccagctggaaggcaaagggaatagaggcaaatgctcatggataattgaggaaattatttctgtggtctgtagcccttttgaaggagtggaagtagggtatgggcaccctttgtcttacctacctccagccatttagctcttccccagtggtctactcagacttgacactatggaggcaggaagaaggaccatattcgacactggtatctatccatttatttgctccttcactcattcattcatccagtgaacatgtactgagtactaattgtgaaccaaatgcttggagaagcactaggtatgcggtattgaaaaaaagagacaaagtccctgtccttgaaaagtttagtctggaggggcccacagacaattaacatgaacagatacccaaatgcaatgtggctactgagtgacaaaaaaaaaaaaagaacagggtgttgtgagaaagacagtgtattcgggggtaggtgaacatggactctaattaggatggaatggccagggaggccctctggggtctctggaaagcaaaagaaatgcaccatgagtgaaggtggaaccaggccaagccttgacagcagtggctctcaacccaggttggcactttggaatcacctaagccactgggagagattacaaacaaaaacaagagaaaacagcaatgcttgggaacaaccctcagttattacaatttagcctagggtagggcccagatcctgagatatatacagatattttttaaattaatagactttattagttttaggtttagagaaaaattgatgagaaagtacagagaattccaatatcctaactctcccctccacaaacagtcgtccctattatttacatcttgtgttagtgtggcccatttgttataattgatgagccaatattaactcactgttattaactacagtccatggtttacattagggttcagtctttgtagtgtacattctatgggtttgacaaatatccagtaacagatgttcatcattcctgtatcatacagaatcgtttcactgctctaagaatcttctgtgctctgaccctgctcatctttccctccctactagtcctgacaactgatctttttcttgtctccatagtcttgccttttccagaatgtcatatagttgaaatcatatagtatgtggccttttcagattggtgtctttcacttagcaatatgcttttaaggctcctccatgtctttttgctgcttgatattaatagctcatctatttttatttctgaaaaatatcccattgtctggatgtactccagtttgtttatccactcacctcacaacagacatgttggtttcctccacattttgacaattatgaataaagctgctataaacattcatggtggacatgagttttcaactcatttgggtatatacccaggagtgcaattactggatcccatggtaagagtatgctttgttttacaagaaactgccaaactgttttacccctagttacactgatttaattggcctaaggtagatcccaggtcctggtatttttaaaagcttcccaagtataattggtcctccatatccataggctttgcatccatagatttacccaaccatagatggaaactcacagaaatggagggtggactggactaattttctatctgaggttagttgacttggaggatagggaaccctaggaatctgaggggccaactgtaaggatacggagggccaactgtattctaagggacagctaaagctgaatatcttgtaggccttgattaggaaccatgtatttcattataagcacaatgggaagtcatcatgaatttaagtatgagtccattttcatgctgctgataaagacatacccaagactgggcaatttacaaaagaaagaggtttattggatttacagttccacatggctggtgaggcctcacagttatgtcagacggcaaggaggagcaagtcacatcttatgtggatggcagcaggcaaaaacagcttgtgcagagaaactctcattttttaaaagccatcaaatcttgtgagaccaattcactatcatgagaacagcatgggaaagacctgcttccatgattcaatcatctcctactgggtccctcacaacacgtgggaattatgggagctacaagatgagatttgggtggggacacagagccaaaccatatcatttcgcccctggcccctcccaaatctcatcttgtaagcacatttcaaaaccattcatgccttcccaacagtcccccaaagtctcaactcatttcagcattaactcaaaagtccacagtccaaagtctcatctgagacaaggcaagtcccttccacctttgagcctgtaaaatcaaaagcaagttagttacttcctagatacaataggggcacaggcactggttaaatacagccattccaaatgggagaaattggccaaaacaaaggggatacaggccccatgcaagtctgaaatccggcagaatagtcaaatcttaaatctccaaaatgatctcctttgactccatatctcacatctgggttatgctgatacaagatgtaggttcccatagtcttgggcattcattataagcacaacgggaagtcatgagttgaagcagagaagaggcatgatttgatgtacatgtttataaagtcattctggcagcatgtgagaatggattgggaaggcctgacgggggattaagagcaagacagaatctgagagaccaattaggaaactattgaattataggtcagagttgttagtaacttatagcaaggtagagatggaaagaaatacatggattcaaaagctacattgagagaaaaatcaataagctttgatcataggttaaacattgaaatgaggggaaacaaagggagaaatccaaggattacaagagatacttctaatccttctctggaagcaaatttaaatctaccctgcagataggcacaaaggttactagcttattttcttttctgtcatggtcttcttttctctttcttctttgttttgtactgtttgtttgtttgttttgtttttgaagtaagagctcctcttaataccgattactattttaagggattactaaactcttacaacctaattgggcataggcctttaaggtcaaactcaatctcctttgcccacatcagaaggctacatgatattttagggatatgttagcttagctcaaatgcttttcattgtcagttacaaccaagagttgaaattttagaagggatagtctcttaagagagtttatcagtcttggaagttttcttctgaaactacccagcagatgtttccaatgccctgaggaaaaaggctttaagaaagagctggtgatgaatagtgcaagagcagcagaggaggttgagaaagaggagcccaccagagttacagaaaaagagctttgcaaaacaggaataagacactcaggtctctaccagctgctctcaaaaacccacctcacattaaaaatcaaggtcatggacaaattggcacaagatggaccaagtggtcatggtggcctctaagttcactcaggacatttggagtcacatttggtaacaggagtagacaaagaggctacctgtcaggaatgtggaggttctgacctcacatgaaagctagagctgctccctgaaaggccagcccctcctcagccaagaatctcacttctactctctccttagctgcaaataccatactggaatgtctgaccctgagcagaaggagccagctttaagctgcagatggcgccacgctggtcaacaagggactttggctggtttctctggttagggtaggtggacaggaaagacttgtgctcagagattctaaagagaacttgagattgttggggacagagagacagagactgagagaaagtgatggaaagacagacacacaaacacacacacagatgtagagaaagaggagaaaagagacattaaaagtaaatagaaagcgagagaaaaaaacactaaagacagaaaagagaagaaatttaaaaagtggaaatggaaaggaaactgaggaaagcaaggaatgagacaaggatggggaggagaaaagagaggagagcctcttgcattccattctcgtgccatcactcacacgggacagttttcaggagttctctctggaagaaacactcataaatcttccataaaacaatgatgaaagaaagctcaaacctgtgcattcatgtcagacagttccatccgctcctgtctcgcagggactgagagctcctgagaccctcttgctaaggcctaggaatgggcaggctctgaggtggaatgggcaggctctggggctggataagcagactctggggtgcagtggggagactctagggtagaatgggcaggctctggtatgaaatgggcaagctctgggatatggaggaggaggaggagatgggaagggaagggatggctgagaacaggcccatcaagggtccagaattcctactggtaagtgtgattaataggattcatctaggacatcctggactataagatgcaccagactttgcgaatgcaagcttatgatgcaatatttgtattagcaacccttggtgtcttttcaaaataaattgccttaaacttgcattttcaaagtggatctctttggggttactggttacagtcctgtcatgaaagtcagtgctaccaacattaattggtagcacctattcaataacagattctgtaccaggcaacaggagacagaaaaggcaagagtccttccatcccctcaaggctttcataggcagtgctatccaacataaatttctgcaatactggacacgttctatgtctatgttattcaatgtagtagccaagagtcacatgtggctattacttaaatttataaaaattaagtaaaatttaaaattagttccccagtgatcctaggcacacttcatatgctcaatagccacatatggctagtggccactatattggattttgcaggcagaggatgagataagagagagacatcaatatatcaatataagggaggaggcctaagaaagataaataaagtgtcctgaataaagttaatcaaagataaataaggcaaagagggaaagcgggaggagaaataaggaatgaatgtttctgtgaggaaagtagcttatacgaaacaggtaagttccaccagcagaaattcaggagaacaaggttgtccctgacagaggacacagctcgagcaaagtcacagaaatgggaaagtaaagcttattttccggacagtaaaaaccccagtttggctgaagtgtaggcaaaggaactgtgagagagacaagcaatagaggcgggttgggtccttatgcagaggactcagctgctagggaatttactcttaatcctgtaaagcagtggggagccactgaggattccacatgagagaaagacaacctttgggaatgattcttcaagtatctacttgaagaaagaaactgcagcagtagaaactgccaagagactgggagagtgatgagggtggtggaaacgaggaaagagcatgggggaaatgaggaaggaagagctgctactggattacaagacagaaagctgtatgggacccttatttctcccacaacaagaatggcatctaaaagtctaactatcactgtgaaaggcagatccctgaagtcatttcctgagccaatgtcttttcagaggcagaatcatccaagaaaggagtgctttctcataatcatttgtcagcccattaacctatatagcaggactccttccccaaatgccgcccccactgtgtcccctcataagccactggggcagggtgcctgagaattggatagaagaaaggaaacacagaagaaaggaaaatgagatggggagaagaggtctttaaaaaaacatgctggggaagtcaaaacaaattcccagccattcctgctggagattttatggggcgagacatccccaaaataggttttgaattatactctgcacctcataaaacacaggaactcttggcagcccgctcacacacactgccctcttgttacctgcccaaccgtccctaaaggtaggcatgctgggaaacccagtggagacaaaagaactcaaggctggtgttctgagttctgtgttcataagtagcctcactcccttgacgtcaggaaatgtagtagccttctcccagcctttgcctccctctgtgcaataagaaagctggatgtggccagagggccctggagttgtgaatttagataatctggggaattggggtgcaaatacgcagagttacacagaacccccatgaaaccatacatgtacaaggtgagggcaaaaaggacttgaaagagaatgcctgttgaggtgtggtcccagatggaaaaaatatttgttaatgtttaattattttctaaaaatattgaaagctactgctgaacaacaacaagaagaatctatagaacattcctggtctttgggaagtcagtgtgatctgggaatttaacagcagctctaacatgctcggcaactttactattggaaccacagttttctcatctataaaataggggatagtgtggggtgcctccctaagaaggccaccccaaagcatgaggacatcaatggcaattgctgaggaatcctaggaagggttatgaactacaacagtcaggagttcctggctcatctctgggattctgtttcctcctctttaaatcagaattttggacaaatgatatctaaagcctcagccactaaaactgctatgacttaatgcctctgtcaacctgaaatgtatatatttcaaaagcttacagctggccttctttccactgactgccagatgagcctgcgtttcatgttatctctgtagaacatttcgggcctccccagctatgaatgcttacactgctaaagtgctgcctctccagcactcaggactttgccacccgttaagttgtattttacaggaagccaatttgttttccagacctgcttatgctcattatatttcttataattacaaaacttaaagaaatagtttactttttattttttatttttgtgtgtatattgtaggtgcatatatttatggggtacatgagatgttttgtgttgttgttgttatgagacagagtctcactctgtctcccaggctagagtgcagtggcctgatcttggctcactgcaaactccgcttcctgggttcaagtgattcttctgccttagcttcctgagttgctgggattacaggtatgcaccaccatgcccagctaatttttgtatttttagtagaaacagagtttccccatgttggcaaagctggtctcaagctcctgacctcaagtgatctgcccgtcttggtctcccaaagtgctgggattacaggcgtgagccaccacacccagctatatgagatattttgatacaggcatgcaatgtgaaaaaagcacatcatggagaatggggtatccatccactcaagcttttttttttttttttttgagggggagtctcgctttgtcacccaggctagagtgtagcggcccaatctaagctcactgcaacctctgcatctcagattcaagcaattctcctgcttcagcctcccaagtagctgggattacaggcatgcaccaccatgcctggctaattttttgtatttttaatagagacggtgtttcaccatgctggccaggttgttctccaactcccaaagtgctgggattcaagcgtgagccacagcgcctggcccatcccctcaagcatttatcctttgagttacaaacaatccaattacactctttatttaaaaatgtacaaaacttaatgaaatattctgcaaattaaaaatttatgaacatccaagaaagtggtttctaggaggactaagttgattatactatttaaaaaaaacaaagaaagtcacttaaatattgctgttgaattaggtcaggtgcgacaactataaaaatttagaaaggaatcataaaactctagaaaaattacttggcaagcatctttaggtcctcagtctcctttaatgaaaccaacactggagatcatatctggtgtattatgagcatggtttatggaagacagatggcatggaactccaatcagctgatccagcctccaagaggcagccttgggcctacatctaataattggcaaatgtatgcacatttacgtattttaagttaaaatgaaatgtttacggtgcgtctattactttttatgattctccactttaatggactttttctactaactgaccaactgccagtctaaatggcttcaaaaacaaggatttctagggcaaggaattaaaatgaaatgtagttagccctcccctgaatagtttgtctccccacacaaatgagaagtttaacgaagaagaagagaagcactgatttagcaatcatgtcaaatgccatgccagagacacccacccccgacaggttgtaataactagtccctttctagcttctcctttgctgagttcagtttcttctacttctcctgacagaagaatcatcatattccacactctctgtgtctcatatgtatctgcatgtatgtatgtatttgtgtacatgtacgaatgtttctgttacatattatgtatatgtgtgtgtgtgtgcatctttatgtgtaaatcaagcaaaggaaaataaaaaaagaaaattccctaagacctacaggaaatcttgagatagtttcaggggcctgaacattctaggggtggtttgtaaagctggcttaatgttaattataagacggacagtaagattccttcaatcacactaccaccaaaaaatgtggaaggaacattaaccatctcctttccaatatattgtacatggagaatggaggccgatgctgtggtttggacatagtgccatccttctaaaatgttttttaaatgtctaaatgcatgttttgttcagatgaaattgaagctccaatgttacaggcagctaagagtggagcacctctgtaacagaaatccagagcaactcatactcccctgatctatcatggaggccagctatagaaaccagtgccctaatgaaaagacaattttatcaatatctctgtgccgcctgcaagaaacttcagaatgaccttggacaaatctcttcccctctttggcaccaaaggtggctattcacaaacatatctattccacattcccataagcattccagcaaactgtttgtcatggccacctttgaggaatgtgtttgggtggaggagagactttcaggttttcctttacaatatctccgaattgcattaatgtgttacaacaaccttgtattctttctgttaatattttttgagatggagtcttgctctgccacccaagctggaatgcagtggcacgatcttggctcactgcagcctccgcctcccgggttcaagcaattctcctacctcagcctcccgagtagctgggactacagacatgcgctgccacatccagctaattttttgtatttttagtagagatggggtttcaccacattggccaggatggtcttgatctcctgaacaccttgtgatctgcccacctcggcctcccaaagtgctgggattacaggcgtgagccaccgcgcctgacccaaaatgtaaaattgaggttggaaatacaataaacacacgtgtactctctgctggagttacagatattaaagagaaatgatgtttaacttagaaagcttacatactaacaagaaaggccgacatgcaatcaacaatatttctatgaaaatactgactgcactgaatatacgaaatgcttgggaaataactgttttggggggagccaggaaagtcatcttagaaggagtgagggaatattcacgctggatcttaaaagatggtagttatgaggcagaaaagatatttttaaaatatataatattaaagataatctgacatttaagtgagcaaaatttgaattttagaggactatcttcgtctctgtgcttgggtcgatcaacattttccaagtattgaaccagagatgaatttagacggcacatgagtgttttaacttcgatagagacatacttacttttgcaggctatcttccatttactgaaagttattttggtgtttcattcatgacagtgatacaaagtttcctttttaaaataaatacagctaatcccattactactgaccttatgcaataagggtctatgagcaccctgcttttctataccactagagatccagcacagggtctgggatggaaggaccactgaagaattactaaaaggtcttaacaccaggcagagatgccaaggttttcgggttgaattggtttagattaggaaatgggaataaaattcatcccctatgctaatcccaattgactggaagtgattgatgaggcattgcattgagaaagaatctcaggctatcattaaatgattgattagcaatgtctgtcatgaatacagaagtggacagtggcagtatggccaaacataatttccactgattattcatttattcattcaacaaatatttattgagtatctactatatgatggacacatctgtaggcacatgggattctgcagcaaaccagactggatgatttctcctctctcttggagtagcctatgcagcccaatcttcccctgctttcctgaaagagacttggctcttacaatattaatcttccctgaggtcaaaaaaggactgccatttatttaaggtcacacaacaaatcaatggcagaaacaggactagactccaggcactacctccaaattcaacacagttgtgtacttaccagacttgaaaaacctgtttggttttcctagctctgtagctgccctttctcagccatcagtctttccacctgctgtccttttgtggggaggacagaacgtctgttccctcctggaagcagggaggcaagtgagtgggggcgattccctagaggcttctgtggtttggagagatggattaaagaggtcaggacaataaaagagagagagaaaagaggggagggagggacagtaggaaccctgccattggcagaccagtaattggttactttgggcagtccccctccctggggaaggctagagagaaagtaattgaagaagattccctgataaattagtgcaagactgggcttgaaaactctagtcgcacctgggttcagagctgagtgtttgatcttcagaggccccagaaaggatagagaaggaaaggagaaagctttaactgtaactccagcctcagaagttcccagagggaacccttctctccctcctgggctcctaggatcacttagtttaatctcatcacattagagatgagggaaagcctgaaaagaggaagagacttgaccacagacacccagcagaactgggaccaaaacccacgattcctagttctagtcctctccaccatattacactgcctctgggttccatgagatctttaaccacatgacttgcttcgagtgatcctaagctctctccagctgcaaaagaggtagggagggggctggtattagggattaaggtacaggcttatttacttttgtttatttaacgagcacataggtagcatgtactaagtgccgggtactgctgaacatactttataaactttagctcctggaatcctcctcctaataaaaaacagaacaacctgatgaggtagtgatccatcagaagtggtgttcacaaactatcaccctgatttctgcccattttgtcaggaaatatctactcagaacctactatgtgatgttcctcagctacgtagctgagggagcaaaatgatgaacaagacacactccctgcctccaaatacctgtcaggtaaaggcttttaaaaataattgagatagctgagagtgtggtgtataagggtgctactttggtccgggaagactacttggaggaggtaatatttgagttttgtgagcaagggaggaaatggtagaaggcaactcagagaaaaaggcaaattatttaggattttgcagacactgaaaaagaatgaggattttatcctaaaaacaatgagaaacaattgcaggtcgtaaacaggggagtggcaaaatataatttattttttggaagacatcactctggctactgtgtagagcagaggttggcaaacgttttctgtaaagggccagttaataaatattttaagctttgcaggctagacactctctattgccactgcttgactttgtcattatagaccataagcagccacaggcaacacataaacaaaggagtgtggctgtgttccagtacatttttatttataggtactgacatctgaatttcatatgattgtcacatgtcaacaaatattattcttctcttgactttttgtcaactatttttaaaaagttaatagtcttatgagctgaacaaacaaacaaacaaacaagcaattgtttagatttggcccatgggctatatatagtatggcataaagaaaggacagagaagggagaggcagcaggaagaccggttaggaggctgatatgggaaaggatggcagcttggatgaaggtgatgccagtggaaactatgaaaagttaattctgaaaatcttttcctgttgttgtttttttgagacagagtcttgttctgtcacccaggctggagtgcagtggcacgatttcagctcactgcaatctccacctcccaggttcaagagattctcctgccccggcctcctctgtagctgggattacaggcacctgccaccacacctggataatttttgtgtttttagtagagatggggtttcaccatgttggccaggctggtctcaaactcctgacctaaagtgatctgcctgcctccgcctccaaagagctgggattacaggcgtgagccactgcaccctgcctgaaaatcatttaagaagcaaaaccatcagggttagctgactgaaaggatgagaggcaaggaaaacgatgaagaatgactgcttagcttgaaaaactaggctaatagtttgatttcctgagatgggaagatgtgggtagagcaggtttagggggcaaatcacacatcaatagtgtgatcccagacaagaaggagagaaacacaggtttcctacgggcttctgaataaaataaaggacgctcagttcactttgaatttcagatagtcagcgagacatttttagtataagtatgtccaaaatactgcatggaacatacttatactaaacaagtattcattatttatctgaaatttaaatttaagttggcatcatgtatttttatttgctaaacagagcaaccctacatggagtggggtggggtggtggtggtggtgtgatggagggtatataggtctccaggaaaagaaaacctaagcccaagaggagaaagagaaggctccttagagatgacaccccttagagcagatgctagagctaagtctaggagctggccaggtgaacgaggaatacaaaaacaatctaaacagagagaagagaataagcatgttaccctcagacatttgcaagtaattaatgaggctagagcctcgagggaggaaaggaacattggaggatgaggctgaagagcttctaacagggcttcacttcacagaggttttctaggtaaaggccagggtgtcaatacacttgctgaagttcagattcccaggcctctccccaggagcctcagcaggtctggccttgagagcctgaggtctaccgtgattctgatgatcagctaacttgaggaaagcctgggttaaataatctgggaactcttccacctacaaatcctgggagccaaacaagttgctgctggctgtaaaagtcttgaaaagagtaattcagataatcagaggaaaggaagcattgaataagtgtgcagcctcccatggggaccctctagaatggagctctgtccatttggaggacaatagggaatccagaatgtttgtcaaaggaccagtcctgctcctgaatagtcaccctgtctggcacctggctctaatttggtgctatctcccagctctgtgcaagtagaccagacgtcttcctgtgccttcccccgatgccccacccccttccctcctccgccctcagccaccactgaaatgattcccccaaatgcagctattactgtgactggaaatctctttactgctgattctgctaatggaaatgttccttcccttttcggctgcttgcaaagccactcgtgacttccctgggtgcatgagagcaaggctttgtcagccagccaccaccagaagggagaggattctgccccgcctgctcccacaacacccacctgccttagactcagtctctaagagctcttctgtcccaactgtcctcaaacaaccccggaattccctgcttcccccagcttcccccagctccaagagaatgagcagacatcaatggtcaatttcatccttttttgccttgctggggaggaggggaggtggagagaggaggcataagaggagcatgagggagtggaaagagggggaggggaaaggaaatttacattcattattgattcatacctccacctccttccaaaaaaaggattccaggtggcgaagaggcacagagcccaagctgtgtgccagatgctgcgctaggtgctttgcacacactatctccataaggatcacacagcttagtgtaagtaaaaagttagcacagtgcccagtgctgactaaaatgtggttatggagggctctccaaaattaagtgactattatgttttcttcatgttattgatgggtaagcagaggctcagagaagtggcatacataaatctaaagctaggaattagcacatctgggatttgatcccagggcttttggtcctcagacctagcaaaagtctcactctagcacactgccaccatcagaggacctgagctagagacttggttgtgctgtggattagctgcaggaccttggaaaatgtatttgtcttcgctacatagatgaaggagttgggttggatctcaaaggcatcattttacctcattctaataatctagaaggatacactatatatttggatttatatagcattataatatattacgtatgtgtgtgtatgtatgtataatatagatcccacattcaaggaggaaacacgaaaactgcacaatgatgctaaggagtactgagtggaaaaatttgacaaggttgagcaggagtgagaagcaagttcacctagccagatagcggctacatctcagactccagacaccctgatcatttcccaaaaaaggacatagagcttatacaaatttctcagaggacaagatcactgatcccctagtaaacacttggcagagcatgaggtgacaactctctaagagttgggaggaaggaagaaaagggggaaaaaaaagaaggaaaggggatggggaagaaaggagggaaggtggaaagaatagagggagggaaggagagaggaaaccaagaaggcacagaaacataggagtttgcttgtcaagtgggtccaggagtaacaagaggcatctggagagtatgagacaaggcctagatgctgtcttggcaaagcagcaaggagcaagcaaaggggcctggggagctgctaagtcagctcctggcagcacagaacaaggtgctcagtcccttgggcctgtgaggctgtcacacctgaagttcctatataagaaacgcctgcagcttcttggtcatgagaagaggatgacataagaagtaaaaaagtctagagatgaaaagttgagagcatctcttgttctatgcagcatgcaaggcagacagaacatagactatggaaccaggcagacctggatttggactgagcttagctgtataatagctgtgtgatcttgggtaggttccttcactcctctgagcctcagaactcaccctataacatgggatgagctacatctgtccttcagcactgtagaaagaatagataacaaatgtaccatcatggcacctgggacatagtacatgttacataaaatggtcacggttttcatagcctatcctatgtaggatgataaagtccagttacattacaactctggaattccaactcctcctgtccccagtttcccagctgcccttccctaagatggaaggaaaacacataggggtcagtagatctgggatctggcatctgctttaccacaggcttggtgaccttgatttccccatctttatatagaagtgtttcagttagataatgtcctaaatttttccatttctgatatttgataatcctggaaccatggtgtatcatttccctgaaacttgtattgtctcttcgtttgctacaatgcaaagtttctaatcatttacctggtttccaagctgctcaagacagagtcttctccaaacacaatgatctttcctctaatcacattgttctcattagccatcctgcaatcaccccaaaataatcaggagacaggagaaggtagcagcaatggctatgggtgcttagaagagggaaggctctgtgggatggatagtgtttaggctcactcttaacagggtagtgcaaattcagcccatctcaagttttgtctactgtggattctgggatgacacttagcaaacacagagttctagttctctaagatctcctgtacacctacaatgtgccaagtaaagggtgagtcaccacagccccagagatgaaggaggtacattagctgctcacagggtacataggcaaacagcgtgagacacatgaggaaacacacagcgtaaattctggtctcactctgctccaagccaccattacttttcatcagtagagactccttcaggctttcctgcacccatcgttggtcctgtacagagcagcgtagggaattcttttgaaacataagtcagaccttggcactgttttgcttaaaattctacagagctcttgatttcactcagagtcaaagcccaaatcctgacagtagtctgtacagccctacatgactgttcttttcttctctgacgtcttgtcctgccacccccctcctccaccaccacttgttcactgcattccagccacaccgaccttcatgctgtcccttgaaaggtccaggtgtgctcctaagctagataatcagctaggattatctagctaggagctgttctccgcctggaatgtgcttttcctagatgctgcttggctaactccttccccttcttttagcctttgttccaatctcacattctcaataagctcttctcattctatcctatttaatattaaaacccgtctccttatctcagaactctcgattctcttttcccttagttttttcccttttccatagaatttttcatcttctcacatactacataacttatttacttattatgtctgttgtcattgtcccctaacacacacacacacacacacacacacacacacacacacacacaacacagagggataaaagctctctgaatgcagagatctttgtcttttgttctctgatgtatcctaggcacatagaacagtgactctcacatcactggtgctcagtgattcaaagggcctggctatgattatagcagtctttattgatagtgggcaccaaggctcagagtgttcaactctggtgcagaggggtcagaaaaggcttcaaaaataagttgacacctgaattcggtcttgaaaagcaagaaggaatttccccaggggatggtgaggtagaggtgccaaataagaaggaagggttcttagtaaaggacaatctggcagagtgtgatcagggaccttgtactactacaatagggagagggaaattcaacaccttcagaacaatggggaagcagtgaagtgctttacaagaggatggccattatcagatttgggcttttaataaaatcactttgtctgcaagtacggaggatggattagaggggataagactagaggtagacagatcagtgcgttgactgttgtaattgtagtagagagaagtgttgaggcctgaccttgacagtgactgcagtgctggggatgaagaagtagtttcccttcatagtttgtaacctacaacatgcttgtcaaatttcaactcacagacttggatgcttacatattccagtatgctagtaagaaagctacacatatttcagttttgaatcttgcattgtgtagtcatcacccactccttttccattcaaaagggagttcttttggggggctattgtccaaaagagctatagtcagtagagaaaagccagtgaaaggagagaacaagtgctagaaaatagaacaactctcattgagcattgctgcctgcctctttctgggggcagagaggctgtctgctccattgcaaggaaagaaaaaccagctctctctctctcactatagttaatcttttgttgccactagctggtcagtatgagaacgtgggagagtatcagctctggaaaggaagcctcctctaatgctgctccaccccaaggttaaacccgactctttttttcctttcctgaaaagagcagatttcctccacccacccccaaaggcagctagggtgagaggcagtgaggcttccttctgccccagaacaaaacccatcagcccaggtgcttaggatagattggagccaatcagttggatactcaggcaggaaaaccaattcaatttccctaaggagatttttccttgtagattttttttttttggcagggggagaggaaagagtgtccccctttatgatgctgaactaacttgtagaatctgtgatatgtttaaacccaatgccttctgtgagaggcccagcaatgtgatagaaagaggcagtgtgggcttcaagacaattgggcttaaatttggactgtagggtaggtttcttcccttatctaggcctcagtgttaccatataaaatagaggggttgaattcaatgccttgtgagtctgtgatgctgggagcccatcaaagtcgacggttgtggtgacagttttccagacttcattcaagaggtcgctgtcagtctatcctcctctccccacatcacacatattcacaatggcctatggcaaacaaggcttagtgtataacaaagcaaggaggtgagaagcaggaggccttgccagccaaaggcctagtcaatcctcctgctgcacctgctacaaattaaaatcacagagtaattttgcagactgaggtcccagttcaggaaaatgatcaagccatgggtcatgccaaagcttgcagatctgcctaggttggtatcactgaccccccaagaaacagcaaatctggtccaccttgaccaaatctaagccttgctaatggttgaaatgagctctcccctctctctgccctacactgtctcaataacatagtactttctgaaggaagacaacgtatttcactctgccctgagcattaaataaatttcatcggctttgagatggaaagaagtggggtagggtatggagtgagggaagtgagtggaaaagagtagaagaattagatcagaggccactaaacaccacctcccccaagacccttgtttataatgtcccagaaacctagaccatcacaccaagatgggaacttgaagtttgactgctaaccaaatatctcaattagcagtaaaggacttggtgaccaaatgaagaaataacatacattgttttaatcctatctttctctcaagaaatcaaattttcttgcttctccatcccagaatctttctctcacacataagaaaaaaaagtggaattgatgctaatgaacattctgtggtcagaaacccctagagaagacacagctcatgactatttataaggattttttcctccctccaaaaaaattaccatctgctttgattcagcaaaaggaggtaaaagcaaaattgagtaagcactcattgtccacctttagaaccaaaccagaaagcaataagggtatacaacggtctgcaaggaagtgggtccattcttcgaatgtctgccaaacggaggtccagtctgtgcttgaatacctacaaggtggattgtattaccgttaggggtcagcatactgggttgttggacagctccaggggacacagcctcctgtagggctcagctctatcctctcagatctttcaagacattcgttagaatcagacaccctccccttctccaacagaaaacatactcttaatttgtgtagacttttctttagggacagggtctccccctgccacacaggctggagtgctgtggtatgggcacagctcactgaagcctcaaactcctgggcataagtgatcctcctgcttcagcctcccaagtagccaccacactcagctcattgttgacatttaaaggaagcttctccagccctctgtggctaaactcccttctcccaaccattcttctggccaggttcctggcacctcactccttcaaggaacatttgctgacctgaacaagttggcatttcaaaccgtatcttcctccttcttccaggccatcagcttcttgcataaagcagcctttgggatggtcctttgggaccccgccagctctacgcatgcaggtgtacttaacacagactaatgaatagcttttctttcttcacactccctcccccaaatacagatcacacgcctctcctgtcaggttgatatggcaaagcaaattactaaaaaatgttgacaatgagtgcttattcaattttattgctttttcctgcttttgctgaatcaaagcaggtagtaaacagtcttgcctgaccactatcaagcacagcaagaaggatgacatttccctacctgtgggcatgaaagctaaatccacaagcagaccccgggggctgcctggaggtaagtgaggactgaatgacatacaggttcaccttagaagccctgggctggcagttgttcctgctcaaattctttcttttctatcagtccttcccaccaccctcatgttaccagtaaaggaaaacagacagtacaaagcaagaggagctatcagagtcatggagtaggtcagggcacttcaagttcatagaatctttacacgaaaggattattttagagctcatctacccactcatattgcagcagaaagaattgaagctctgggggataaatgacttattcaaggtcacagtgagccaaagctgagatttccagatcctaaccagcgttaaatttctaagctgcattttagcattccacttttcctcattttgcctattaaatcctccaaggcctagttcaggttctttctggtccagaaagtgcccccagtcttctccaattctacagagatgccttccttccctgatgctacagaatgtatcatctccatcactcattggcaccaataaataaaatgccctttgacatccaagagtcatgaaactttgagctggaagggtcattggatgtcatttaactcatatttcagtttcaaacttacataggtcagctcaccaaggtagctgaagttcctttggagaaaagctcttgtctaacaatcttgatgattgttatccctctctattcagcaccataacctgcataaacttcatatttggttcagaataccagtttagcaacctacaagaatgtaggtgtctggcagaccaggattccagttccaggtctgccattgattcctggcatgactttggattacgcgtttgacctctctaaaaatacttcctcatctggcaaatgggagtaacagtagagcccactccatatatgttatgtaaattaataatacaaggcaggaagaaagctcttagcatcacattaaggattcaataactatttgctattctttgatcactttcagggagattcactttgtcaatgtcattgacttataatcagattctaaagaagaatcccaggcaaacaaactttggagatagttcacaactgaaggaaacttccatttacttaaggcaggctgaaatttgatagggagactagaaatacaaaaaggaaaggatctgcaaaaaaaaaaaaaaaaaaaaaaaagacttgcttccagtctgggcattaccaataacagaaacaaaagaggcagaatggagggagccagggttaaatatgaaggtgaccttggtgcacgcagatgggagatagtgcatgcaaaattaccttgaggtcccccactggagtttgaataaactaagaattcttctttttgtttgtccccctttaataccagggatggtttaccaccactaattctggtcccaggacccaaagtgaccagagggctttggtggacaccatcaccccctagtggtagctccacactccccactattggcagagtttggcatttaccaactttgcatgctcagctgtggcactggccatgtccgtatcccctgaactgataagctgatagtgaaagctgcccaactcgccagagacaaacgttaggcaggatgtttaaaagtctggggatgggatggggctgccttgggacactagaaagagatggccataaatgtctcatagtatcagccccaaccccacccctaccaccacccccacctcacccctcccccccccaacccccagcgggcaccaactctcatttccggccagctaggtcctcccagaactcattgtgcactctgtgtttacacacaaacagtggaagaccaacacaaataaaaatcccacgtctccctacacagctcctgctatacccagccatctggtgactacctcgctagccaaatccccgttgagagcgcctaaagctgccagcccagggcgctagggggaaaaggaggaggcaagaacccaatcccccgcatgcatccaaaaggctcagcgctgccaaggaggccagccccgtgctctccaaggggcagagggtcccaagctgccaggctcagggaccgtgcatcagaggagggggaagtctccatgtgcaggttgttgccaggagactctcaagcaacacatgggtcctgggggaatcaagacttctaattcctcgctcaggtcctcactcagcttgtcccaggctcacaggcacccatcctgtttgaaagccaaagttaaaaatggcaaagattgtcagttccaggaatcccggggcacctatacagatggttggagcaggtcctccatatcctcgaagacttgaaatgctctgtggtcctcactgccaagtcaggccatacccaaggaccgtctcatcccttcacttgaatggccgtttggggggcgggaggatttccacccctcatctctcagagtaccccggagtagagagatctaaaggatgaagggagaaggtcaggaatggaagtggtagtgaagggataccttctgtgtctctagaaagacccttccccacggggaggtggcaagagccagctgtgagcctgaggttagtccggcggcgctctaaggaacaccacctccaccctccttccctttctcggacatgggcagccccacaggtgcacgtgggaagagctactggtttgtgtgtgtctgtgtgtgtgtgcttggtgcgtcgcaccccagaagcgccgccgcggggagtccccgaggaacctgcaggacgctccgctgcctctcctcccggaacgctcggcacgctcaggttacagcctgcgagggtgggtacaggggctcgacccccgaggttcaagctcagagcgggagaaccactggcactcgctcaaatccccagaggtggtagcatgaaaggatggggagtgggtcacaaaaatacttttaacaatatcagggctaccaggagagtggagcgtagtccgctgattattctgtgggtcttttcaggcgagcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagctatcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggtagagggaggctctaaacgtggagacctcggagtcggaatcccagttctcagcaaccactcaagtctctccagccctatttcacagatggccagaactgaggctcagagaagggaagcgacttggccaaggtcactcagcccatgcggaagccacgcttttgcgggttgagcgattccacacggaactactccattcctactctcatgaaaatccatctggaagggcagaacccgcaactccgaggcgagagcgagggggcggtgacggcgggtggccagtgacggtacccggagaagtgggaggctcgacctgaaactggcttaggatctgggatgctccggcccctagccagagcaccttcagtgaatggggtctccggcttccgggatggatcaagcagagctccaggtcgggactgagaggcagaggggcaggttcccactgcgggagggttggcacgcccccaggctcccgccgcgcgctctccaggacctcctcccacatgctcgtttccaaccacctgtgcgacctctgggcccctcctctaccctctgccaaccccactcggggcagccccgggcagggatccccagggcgcccccacccgtccggcatgacgcaggggctcggggttccttgggatctagcgcgtgccggcgcccagccttacccagggtgaagaagggcagctcggtgttgtccaggtcgtcctgcaccgcgatgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaacc

SEQ ID NO: 1956 - DNA, 261992 bp, Homo sapiens
gaaagagagacaataggaatttttaatgcatggacaggcctgcagggactctgggcagacccacaggtagcaggaagaggcagggtcccacaaactcaataatgtccagcaaaaaagagagagaagtccttaaagacccatgcttcctcactgcaaccatcctcagagcttccttcctggtgctgaagaggtcaaaactgtctcctctaggggtcaggtcaaaactgtccctccataggtctcctccaggggtccatggcaggaagaaagcagagtgtggcaggaagaaggaagaagagcaaaggccgcttggtctccacctgaaaacttctgcctcgggattgacagccatccataagaaaaggtttaaaaaggagagacttttgatagagtcaaataatatctttgaaaaaataaaagatagagaaaaatgaataattccattggttacaaaggtctctgtccactatccacaggagaaaccgtttgctttggccttgctggcaagcttcatctgctaggcccatcctcagctgtcccccagcccacccaggccccaggatccaggagaatactgctccccctcccatggagagtctctgtgctcacggagggcaataccctccctcaccggcccttggactccccgtacgtgtttcgggccattgacaccatcttctcctcacacgtgattttggtgtccttgaggatgctataccacaccatgcctgcaggccggacctcctcgctgcggcagaaaagatagggcactgtttccacgcggctctggatgtaggcactccgcaggaggctggagcagtggctactcaccctctccagtcgccgtagaatcaggtgggccttcctgaaaggtaggatgagacagccatgattaaagaagtccagatcaagagttagacctttgaggtagtaaatgtcaacaaacaaatggtaacttctcccaaccatttcctatctactccagattggagtgtggtacttcaaacactgattcaaaaattgccctagaacctatcttcttcaattgtgcaatgtgttaaaaaatgaaaaagaggtagagcctttaacctagtattttcacttctaggatatgggagccctaggagttcaaaggtgaccagccttggactctgatcaaataggtattattataatgattaaaaagcaacaagaacaaccaaaagttattgacaccatatgctagacactgggtatgcattttacatatattttacattttttatttagcctttataactatcctgaatgtattgtctacccccttttaatgggtgaggagctcaagcaaggctcagaataatgacattacttgactaaggcaaacatcgagtcagccactggagttgggaagaatctaaatctaggcctgaccacccacagtccctttctaactgtctgtgttctcacttcatgaactatttcacactcttttctctcagtctggaaactttgaaatcttgccctttgtgattccctttcatcaaatatatatatatatatgtccccaaatcagaacttttctgtgtctcattttttcccacctttaaaaaagtgatgatggtcttatcctcaagttaagtaagagaaatgcctaatgcctggtatagagctcagagtaagcttccaataaatgatagctactcttataagggattgctggaatgcgccctcaggatcaaggttatgctgaagaccagccttaccaagaattattccgtactatggaggacatcattaagaacttatctagagccctatatccagcacgagagaggggagctgggagagatctgatggctgcacagataaataaagccaggaaggattcttgcaatcacctagtccagggtttttcaaaggtggcattatcgacattctgggctgtatatttttttgttgtgggaacaatcctataggacatttagcagcatcccagggccccacctaccgccagtagcacccttgccccggtcgtgaagtgtgaaaattctttagacattgaagaattttcaatagcactcttgccccagtgaaactgtctttagacattgccaaatatcttctgggggcaaaatcacccaagttgagaaccactgacctagtctgacccactttcattaaaaatgtggaaactgaggcttagagaaggaatagaatatctttatcccaggtcacattacaagtcagcttcagtgtcaaggtgtctgtctccatgtggaaaccacttttctctgcattccagcatcttcaagatgccaggcaccctgggaggctacatgagaggttctctctcctgctgtcctctccatgtccctctgataccacaggagggaaggagttttacaacaacagaccccacaaatgggagactgtgttaggcacctgcatagcagctgaaaaaggaccgagcttatgtgtatacattttgtgggcacaatttatgaggtgcctttcaaaaagtcctctttgtatagttcaccacttgggtggaatatttcctgaggtgccaagaattcatcacttcataaccacactctatccacagtcctctttcccctcgggcaagtgccccccccaagaggagcctgaggagtttcttttccattccttctcatttgagttctggcttcattctttaataattctgtgtcctggggacatttacttaacatctctaaatctgtttcttcatttgaaaaatgaggctgttgtgaagttgaaggagataaagtcatttcttgctgatttgttgagcatttattatgtggcagaacttctggtagagaagatggacaaatggagatgacaatacgaatgacaaaagcaattataaaagaagtcacgagagctgtgtgaagacagaggaaggtacttaagtaggatcaaggatgtccaagtaggcttcctattatagtagtagggaaacatgtgttgagcctcctaaatgaataggagttagataaagaagaggaaaaggtggccgggcacggcggctcatgcctgtaatcccagcactttaggaggccaaggcgggtggatcacaaagtcagaagttcgacagcagcctggccaacatactgaaaccctgtctttactaaaaatacaaaatttagctgggcgtggtggtgggtacctgtaaccccagctactcaggaggctgaggcaggagaatcatttgaaaccgtaaggcggaggttacagtgaaccaagatcgcgccactgcactccagcctgggcaacaagagcaaaactccacctcaaaaaaaaaaaaagtaaaggtaaaagcatagagacaagagatgcatagatgttctgagaatttatggctacaatacagtgtactagtggggacacagtgaaaactggaaggagccatagccagcctgttgaagcctaggaactagggcagtggttgtatgcagtaatgatacaaccacaggctccagaacaccgactactcaggttcaaatcccagctcagccactcactctgtgtgatactgagtgaagtgctttaccacttgtccctcagttttcttaccttacccacaaaatgaaataataactgtatctaccataaagtgttattttttaaataaaaaattaacagacacataataaactgtcaataaatgttatctatgattattgtcttgagagtaagtgggagagttattgaaagatttcaagaagcaaagtaacaggtttggagctgaactgtttaaaaatatttctggttgtttgaggagaactgagcggaaggaggcaaaacacagaattaaaccaagtggaggccaggagcagtggctcacacctgtaatcccagaactttgggaggctgagatgggcggatcacctgagatcaggagtttgagaccagcctggccaacatggtgaaacgctgtgtctactaaaaatacaaaaattagccaggccttgtggtgtatgcctgtaatcccagctactcgggaggctgaagctggagaattgcttgaacccaggaggtggaggttgcagtgagccaagatcgtgccattgcactccagcctgggcaacaatagcgaaactctatctgaaaaaaaaaaaaaaaaaaaaagtaaccaagtggagtgcacactcaggtgttaactgtttcccactgttgtacttacaggtgttggtttgatttttctctacactggtaaaaagcttcttattcttggtttgctcatctatacaaagggaacagcagatggctcacctcataaagttatagtgagggttaagtcagtacacgtcaaactcttagaaaattacttggcacaaagcaagcacctgatgcttgctagaaagtatcatcaccattatcattactcccaccaccatcactctcattgtcatcatcattattacatcattaggtgtattttgtgtactgggcaatgggacagatatgaactagtttaagccttgggtatctttataactcagtgacaagagacaggcagacagaaatattaacattctctaattcgggggcagagcactgggttgaggaacactacgtatgctgttctgggaatataaaagatggacaccagtcatcagtttggagactcagagtagtctctcaagaggacgccacacctgagctagttcttcaataatgaaacagcattttcaggtagatgagaaggcagaggaaatagcccatcccaagtcagaccggagagaacataaactactagttgtttgaaataaccagtgcaaagaatagggagaccagtgagcttggcagggatcagaccaggcagactcttccaagccatgatgtagtatttggattttattctgggcaatggagagacattttctgattagatagtcacagaagtaagcgataaatataaatacaaaatgaagttggaaaagacaattcttccaacatgcccaaatgcccttcttccaaaggaacagacaaagcctccttttgaatggattaggaaaacatatttggagtgagaaagtgattttgcctttaaggaacaccttgagtagtaacaaaggcaaagctagaaccagggttcctgattccagggtgaagatgaagtgttggctctagaatctcagatttaaatcccagctctataacttacagctatgtggttcatgagcaaattattcaatgccactaactcttagttgtagcatccataaaatgtgaataatggttttgctgggaggatgagataataaggaaaatttgcttagctctaagtaagtgtcagcaatgattcaaagcagaatattatcgtgaaaagcacataggctttagagtccataagggcaagtcacttcacctccctaagcctcagttttctcctgtgtaaatgaaaatagaaatatttattttgtagggctgttgttaggttgaaatgaaatgatggctacaagcaaccaacacaagactttgtacgtaacaggcactgaaccaatgtttgcatttagaaaacaaagaagaattcagaaagtaaagccatggagagaagggttggaggtgctcgaaggctggggaggagaaggaagagtcggagtgagagagaccaaaggcaaaaatgctggctaataaattgtaggcaatggagatccataaatcaaaaggtcaggcatgcttcaagctttccctggaggggaaatcataggtcagtgaccacttttgtcaaataccggaaatgaaatcttcctcattggagataggactcagacccactgggataggaagcaagaggtgagggagggccaccacatactaatttattgttttatcagcaggcaagactgagacaggaatcgcttgtgaaagagtcaggggctgggcccagatgccacttttccgggactgtagaaccattctattcccagcaccatttcccaatcagctgttgactcacttatcagacaggacagagacccaatttctaaggggaccctgaaatggagaaaaataagacaggcaggaagaaaacattcccattcgcctccctccctcctccctgccttacggagttgagcttaagtgtctctgtgttagctgtcccgaagcttaatgagaattgaggacatgatgtggttgcaaaaaaatgggaacatgaccttcagaagtggagagggcagaggttaagggaagtaatggcttcattcatggtgtcctcgtcgggctccatctggagaacccccgacacttctggtaagagggacacatgtaaattgcagccagatcatgatactgaggggtgtttcaaaagcaagcctgctgagctgaaagcaggaatggagagtgcccatggaagagaagatttaggccattagttacattgttgtagcaacaaaagacaagtgggcaacaatctgcgggtcagagatgataatgactacaatttattgagcacccactatgtgccagaaactgtacctatgcaacattattttacatctaatccctaacccaattttagagtctacaggtgataaaaatgagcttcaagccagtcattgatttgaccagggtgacaggaggatagggcggggtttcaatcctctgctgtaaggcatcaaaacattatgacacagtcaccctaaaattatcagaagacacatttggcttaaaataataaaaaatgtaaagctaaagtcctctaaatttagaaagggttattctatgtggcagcgggttcctcatcactggaggtgattaaatcaagtatgttttagaaaggggtgtactacagtgggagtcgtagcaggcgtttgtcattgtttatttgtttttaatctaaaaggcatgagagccttgattcacagagaaatatcatctgatgaccactcacttcacaacaaaatttgctgtgacacaattgtcaagcactgaattcctgagctgagaggaccacttttgctgaggttctattcatgactcaaagtcacactgaaatttcatcttcaggaagtcttccagatcttcccagctatcataagtcatgttttcccatttgctgctgaagcattttatttatctgtggagatccatatcacattttttcttagtgtgcacatatcttgggatgtaatgtggttttacaggacaccagttgaatatcagaagacaatattctaaactcggactccaacacttagtgtttagaccttgcaactatggacagtttacataactccacaattctctgttgcctaaccttcaaaatctattgttcaggatattaaatgaaatataaataactgggccaataacaggtgctcaactaatatttcccacctgcttcttggacagtgtaggtttcctctggtgtccagctctttactgtgcaagaataatgaattaataaatgcaaactgggattactcatgcctgtaatcccagcactttgggaggctaaggtgggcggatcacttgtggtcgggagttccagaccagcctggccaacacggtgaagccccgtctctactaaaaatacaaaaattggccaggtgtggtggcaggcgcctgtaatcccaggtacttgggaggctgaggcagaagaattgcttgaacctgggaggcagtggttgcagtgagctgagattgcaccactgcactccagcctgggtgacagagcaagactccatcttggggaaggaaggaaggaagaaaggaaggaaggagggaaggaaggaagggaaggaaataaatgcaaagtgacttgaactgagaaaattttcagtccttagctttcaaaacacagcaactcttcagcagaggtcaataaagggaatgaaatggcataaaagcatcatgtggacctaaagaaataatcaggcaagtgggcaaaaggtttatgtggatttgtttataataacaaagaaactgtaagaaatctagttggtttttaatacacaaccagattaatgagtgatacattcacatatttgcatgactaaaggacccttcaaaaaaataaaacatttacatacgtatctgtgggtaaaaacttgtaaagcatattgttaaacagaaacaggcagataacagaacataacttatgtatttgttaaacatagtagagatgaaagagctgtggttgtagacatgaacatattcttaagcctgtatctgtttccccatctccatgcatatccatatctgtatacagaaatacatgtgtacactgttaacaatgtaatctctggggtagggttgggattatgtggcccagaggtgcacaattttcattattttatatatttctgtatcatttggattttatataatgaacaataattatttcagaacaaaataaaataaaggtattttcattttaaactatgaatatatacacatatatttttaagctggtgtgatgaacttgtgcaatgaagccatggttttatgactttccagtagttcatcagggttactttcaaaataaacccatatcaaatttagcctcagcttgctcctatccaacaaagtcagaagctcagatactgccactggttatatacctttaacaccaggtttgaaatgtgatttgtaaggtgcccactgaaaatgttcgcatttgctttctcttttcatccactcagaagaaatcataagacttttcaaaaatgtgttctttgataacagaaatgactgagtctcaactgatccagagctatttcagttggaactgataggaacttcaagaaaataactaaccttgctatatactgtcggtggggaaaacagatccatgggacactagttcaaagtccaaagtcagtgtgttttgttagtattagttagttggtattagtatgagtatttatttgttaattgaaggtataattgaagataccttcaattataagatatacccatgctttaataacagccattcaagaaaagaggaatacaatgtttaatgtacacatccactgtgcacaatccgtcctgattttagaaatgccaaaatatacagaaaaaggttaaaagtacctctgagattataggaatatgaccctagaagcctaagtctgctcttgttcccaatatcttaaaaattctgagagttaattcaatatatccaaagaagcagttaacacaatcttggaggaatgtacagtgacatcccaggtttgtttgttttcactaagaacacagcagtggatgtgtaactcttttcaaatcccatggcacgttgagaaagatcctgtgatgatttctgcgatctattcgtaatgtctgccatggaggcaagaggagctgacatcataaatacaccattcctggtccagatagatcaatttcactgaagcaaaatgtcctcaagagcttgctgtgtcctctctaccaatatgctcaaacataattgaaagtgtagagaagcccaagagtggtcaaggatgttctgacccgagaaaattctggtccctggccaccagtgagctcagtttttcaagtctcctaataggaaccttatgtctggggacagctgggtgtcagtgcgtcttctttgagcagctgtttgcagtaacctgtggtcgtaagaaccaggctctgggggacactggcctgatagatttattaggcagaggttaagagatgtcctttcgtcactaaatcttatggggatatatgaccacagatttaggaaagatttgaaaacattttggggtttagtgattacacagtccaagagaatcctaatagagctcatcttatatcagtcctcaaagtactcctggaaaaaactcttatccctctagtcaacctgggtccctcagaaacaagacgtgcagggctggaagtcaaatgatactaacaatgtgtctgttctctggtctctatgaccttcagggttttctggttccttggcttcccagctggaagagactttggagttcagccctttcatgttacaaacaaggtccagaatggggatggcttgtgtccaaggtcacacaacaagtaggtgacaaggctaggacagaagccctgggctcctggctttggagaagcatcttaccctctcttatttacactgtgatgttctgcatacttgctaatccttgaaaggcagagcaaatgtatccaaactgctcctctgtttaaaacatttatatggcttctgggagaaagaataaacttgtgaacagaactcacaagaaccatcatgatctgtcctttgctaaacaacccagccttgttgtttttgtttgtttgcttttccttttcactttgaactctcctctttcacttcgaactctcttctccaataagatttatatttttaactgaagtatattatcttacccaacttctctcatctttgcattggtaattccttctgatgagaagactctctcccttccacctggaggacccttcttcattctgtttctaaacttagaaacattctttcttttacaaggattcttccttgagctccagatctggattagctgctccagctttctgcatctggaaccttgtcactccaagtatgcttttggggccaacaacattaacatcactatgagagcttgttacattggattttttggaatgttagaagacctcagagttcatggaattcagtaaatgcagaatctcagacctaacccagactactgagtcaatttggaatgtaacaagtcctcaggtgattctcaggcacgttaaagtttgagaagcactgctctaaaacgcttgtccattcacatgccaaatgccaccgcaattgctggctgaccagtcttttccgcactagatgctgaaccttgtaaaggcaggatctctgccatcttcactctgtatttttagcccccagcacacggcctgacacatagttagcacattaaatgaatcaatgaatcaatcaatcaatgaagtgagatctcttcaagtcttttaatatttgcaaggacattgcattttttggaatgttagaagacctcagagttcatggaattcaattgtttccatctgtgatctaaagattcttgagggcttggagagacataagggatgcttgggattgggtggggtggaggggcatagaagaggagacccagcaggtgggactccaggccacccactccagtttctaccagaacaaatctttagtcatctggtccacacatttaaatcatctcattactcaattactcaacaactaattatttagcacttacttacaaatgtgaatacgacataagggatcactaactatacatagtttacattgtagtagggaagacagataatatgtaagtaaacatacaagcaatataagattctaaatctagtaagtgcaggaaagatagttaaaccattagggtgtgacagagcaaatgggcggacattttagagaattctctgtggaggtgggctgtgattccatgtaagatttatttagaaaaaaagggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactgtcgcaagaacaaaaaaccaaacaccacatattctcactcataggtgggaattgaacaatgagaacacacggacacaggaaggggaacatcacactctggggactgttgtggggtgggggtgggggagggatagcattgggagatatacctaatgctagatgacgagttagtgggtgcagcgcaccagcatggcacatgtaactaacctgcacattgtgcacatgtaccctaaaacttaaagtataataataataataaaaaataccactgttctagttcgtccttatcatgttataggtgaggagactgagggccagaaagcggcagagcccagggttgcacagtgagcttattagcagcaccaggatagattaggaggcagtttccttgattcctgctgacatatcagtgtgggatgttggagcaatctcagatatcctccaggagactagaaagaccagaggaggaggaagctgggtgacagggtggggaggttcgcagacagtggctggtgactgcctgactaggggttagcgggttatcacaaaccattactgagtggattgcctggcctctgtgggcggcccggccgcctttccagaagatttatgtcctggaggctcataaaggattccaggaggctgtaaagacaaagtcagaagtggagctgtggtttagcttccacacaaactccctgagccctgtgggaaagcccaaaaaactggaatgccttcctctgtccacaggcaagatggcagctgagatgactcacacagcggctttcatctggggctcttcacttctgcccgccagtctggccctcttttaggttttatctaaagaaccttcctttcatgtgcaagggagaaagttaaagtccaggacccaacataactgataaggccttgcgctggacagagatccgttttatccctggaccaagctctcatctctgtccctgagagcctcaaattcttggagggccattgcaaatgttctaagggctcaaggtaagagctcaaggcagaactggcctccatgtcaaactctgcacaactctgggcagctcattttgccccatgggacctcaatttccttatcgtccaaaaaatggcatgaataccctacatggtcattttgaagtttttaaatcatgaagtgctgcccactaagtatttcaagaagtcatgtgattctctccaatgcaccaatgccaccctggcctagaatgctatgctgtcttcctgggactattatcacaacagcctctagagcctcactgccgctttcttaccttgacacctatactcaagccagagggatctttctcctttaatggtctgataatattactcctttttgtgaaaaacacttcaaaagcttaccattaccctaaggagataatcccaacttcttaacctaatttaaaggacattcaggatctggctcccactgacctcccccttcttatctcttaccactcctgctgtcacacactttgctgccactacacagaaattcttcagtggctccaaacacagtgtttaccaaagtgtaggccgagttcctctagggtagggaaaggattttaggtggtactcaagatgatcacagacccaatattaaacaaaaatgaatcatgtgtgcaaaagtggctagattagctctttcattctcttcccctctttcaggttacttcaaaaggaaaatcttgggccgggcggtggctcacgcctgtaatcctagcactttgggaggctgagatgggcggattacttgaggtcaggagtttgaaaccagcctggccaacttggcgaaaccctctctctactaaaaatattttttaaaaattagccgggcctggtggtgggtgtctataatcccagccacttgggaggctgaggcaggagaatcgcttgaactcacgaggcggaggttgcagtgagccaagatagcaccattgctctccagcctggccaataacagcgaaactccatgtcaaaaaaagaaaagaaaatcttggtttggggctgtgtctttaacatttctctaactaatctcccttttgaagggacagcttcaggctctgctagaattgaacaacattgttttctgttttttgtcttgttccacttttgttgcttttgttcattgtcttgaagggttaggtttaattttctattaagggtagatgatgttggttttccctttacaagatgatgttgtgttttctattcaaatacattttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaatacatttttaataagaagtgaatataagaaagaaataccaaataaagtgtatatggtggtgagatgacaaaagtcataaaagtggtaggcaagtgatcaaaagttgagaagaaaacttccactgtcatgtaacattttctcttctgagcattccgtcaggtagtctctctgctccaaatacccatccttttcccccacaaccctcacttaccttaccccaactcaaaccttaggcatcagtctctcagccccagtgcagcttcattgggtgacctagaccagatgcctatgtctcatgtatgttcccaaagagttctgttcttctgctatcatgacgcttattattcctgctctacataactgcctgtttatgcaacaagaagctatgtataggtagcaaccatttctacctttttatcgttgcattgtcagcagccaccacataagaggtgctgttaagtatatgctgaatggatgaatgttgctagatgcaagacataaaatgcagccaccattgcatatactgctttatgaagctttagaaaatagtgactgtgccttagttctgtttgaatcattcatggttcctggcatagtgactggcatgcaggacaaaaataaagccttcatacatgttgaattcataaatctatatagtcatgttcactaatggactttagtcaaaatcatagctatttactgtaaaaaaactcagacttcttatggaagactgagaaaggccctggattatgggtcatggccccactgctgttcccctctgtgatcttggttaggatacaggccttcaaagagcctaagtttcctatctgtaaaatgaggtgggagatgagcaaggagaatgattaatgcaaagagcatcaatgccctttccccattcaacattccaggagtgcaggaatctaaagttccaagattctttcattatctctgcctattttctatctttagccttgacacgaccaaggtgataatcacccttatttacttgataaagcctagtctcagcctatggggaaagggtccagaaaagtcaactggaggcaaaaagaatatgcccctccaatcacacaaatacgcccatacctgggccccagctcatcctcacttctccagacgaagtcgccaaacttttcatagtgagagttgtagtggtgctggactcggaacagcatcgaggctgagacctccatcagtgtgttgtaggccatctgctgctcctttccacttgtgtacccattgtacagattgtagatcttgtcagctatttctgagagggcagaagggcagaaacagatcactgggtggtgaaaaaaagtaaggatataagcatgggcttcaataagaaaggcacagtggtgagaaagtttgcttgcataagctctgggagcagacaaaccttaatttcatcttgaatatgttattgactggttgtgtttggttttctgtcatctggaggtaatgatgtctattctggaggtgcattgggagagctaaattaaagagtggatacaaagcactcaacacagggtctggcacaaagttagtgctcataattgcaagcttaattatcaatataattattgtacctgtgattttacatacaattggcttaaataaattgtcttggataatctcaacaccctccttctatttcccctttgttgtatttccaacacatttctgtgatcaggtctgataggtccccatttgaaacacctttcaaagataatccaaactcttctgcttgttgttcatggctattcctactgcttcagttagtcctactaatcaaagtaacttcaatacatcatgagtagaaggcatattcttccagcttcaaaaaccctgtcaaaatctgtatgtggtcctaaatcattaccaacaacagttgctgctaggagaatctggaaacttaagagtaaaaatgggaggaacactatgctcctcccattatgttacactattttctactctgatttttatttgtacttttttttttgacagtggacgtgttattttaaaataatatttttaaaaatttatcaggaaaatgtttcgaatcccctcccctttggtagcacataaaacatttataattgagtttattattgagccatctgcagaaatgtctgtctcaccacccataatgtgaattcctaaaaggggagactatgtctctactgcattgcttggacttttgagaaataattgttcaactttaagtagaccaccaggacttatgagccactgtcacattttgctagacttgatgtagaaactgcatctacacaatgctgaagaacaaagtatatggtggatctgattgactgattatattttttcaggttatttttgcctgctgtttatgtcatgaaccaggagcagcaaaaacatttaatcttgcatgctaactgactgataatcactgatggtagctctatgctaaggattctgagaccaccatgggactggatggaacagcatgctgtgatctgctaatgatgtctgctatggacaccacaaggtgaaatggttttctaggtgccatctctttgctactctagcaacgacaagtgggagaaaatgattggtccctgagaaatctaggccaagggacaagatacagttatggggctctgactccctaccatttgtggcctgtaagtcagaacacagatcaactctctaaaagaggaggcaagtctttccactgccaaagacattgctagtcaatcttaatttttcccttcatgactttgattaatttagctccatgttcctcctgttcccttagtgccttcaatttcttctccctgtgccagtgtgtcagggtgtgcgtgtgtgtgtttaatgattagtgactgttgggtgcagaacttaggggaaatatgggagttactttggagttgaaaaactgggttacctaccttctgccttgttgtcatctaccagtggacaggccgtcctcagggtcaccgtgcttagctctgagtgcctccctcgtgtatccacagcatacagagtgaacctgcagcacagcaagaaaacagagcaccaggctgtgacttcacagaaggccctgggagttgcagggaagaacagagagtcatggcacatgaggctacaggaaaaatgattttaaaaaaagaatgatacttataaagcatttattgagcactaactgcctactcagcactttgcacttcttaaaagggagggatttattgtcacccacatcttgtcaatgaggacactgagacttagattgtgtatctttccacagtctcagttactgagggacagaatgggggtattgaactcatgcagtctgagtccagggtctgagaagtgagccccattgctatcctttatggctggatatatccatttatatattcattaatttactcatttaagaaatatttattgagcatttactgcacaccaggaagtactttaagtgctaaggtcataaagatgaacaagagagtcaaggtcacagataaaaaaagtaagtaaaatcaaaaagtaaacaaaaaatcagataatggttaagtgtgaaagaaaatataccagaataatgcaaaaaagactaatgcgggagcatggggagtatgggctttgggatgtagcccatgaaagccttcctgaagaagaaacttcaggacctaagacctgaatagtgaggaagaaccagtttatggaaggaagacctggggaaagagcattctaggtaggatgctcagtaagtacaaaggtcctgaggaaaggagcccagacggttgaagaaatgggcagccagtgtggctggaacaaagggaaatgaggtagaaggtcggtgggaaccttgtaggccatgccagggagactgggggttaatctggctataaggcatatccccacctttctatgatgtcatctgaagttccatgctatattgatggaagcagacacagcctgtgtggccttagaaggaaagaacaggtaaaacgtagacctggtagattcaagtctaatccagagcacataattgtttctagagcagcctctgtcctctgtcctatctcggggaagctctgtgacccttgtattcccagatctccaagttctacagttaagcaaagtctaagaagggagcagaaatgactttctagatgatgtgagccttagaggccaagaacagtctgatagaagggttgagcatctgagtgttctgtctgcatcatgtcatcctttttcaccagcttttaagggtagaggcagtagtgtgaagtgggtagagggttccctacattaagtagaagagactagggtcataatggccctattttcttccctcctcccttgcatctcaaattatcccatgttataaaatacgaaaaacactatgattagcaagtttcagaatgctgagccctgattggccatacatacttgtacttaataaatataagttggtgatacaaattaattattatgtgctaagaccctaatatgtgtcaagcactgagctaagagttacctacattaacacaattaattcccccacacaatcctaaaagacaggcactattactctctttattttatttgtgaggctcagagaggggaagcagcttgcccagaaccacatagtaattactaggactggcaatttaaaccttggtttctcagactctaaaattcatacatgcaaccactgtaagctgttgtcttctgatcacagttctgtagaaatcaactctgtaaaaatgtgattccattagccacacttgctgaaccccaactatgttgaagcagtgccatctcataagtttttctgatcttatgaaaacatgctaaaataatcaccctcattatctatacctttcagaagataaaactgaagatttaaaaaattaagcaatgtgtccaaagtcacaggttcagaaaattaaggagccaagactatcatctgtcttactctaaaacccacactctttgctctcagctgccattttattgctcccactcgcaggctcagggtatcatatccaggttacctacatgggcccttccagctttgacttcccatgacctgaggcctcaaaggttgttttaataaagggtaccacaagtcaaaacttcttggtacaaaggaagcagggggtgacagaggaaggggcccggtcttggagatggccagatgtgggttcatattccagttttactgtctagcattgtgaacttgggcaagtcgcttcacctctctgagctcactgcacctctctgcacccaacatctgtgatagactgccacccacctcacaagtgcagtatggatagatgtgaaatgtaagtgcactatgaggtaagttatcattggaaagccatgcagaagggttgagaacaagatcataaataaatttaaggaggtgagagtaagcaagtggcaaggtgggaagtgagaacagcatcaggcaacattatgtaagcacttatcatccacatatggacccatctagaaagtggcagaggcaagatgcaaatgctagcatgcatgactcatagtgcatacacttcggcttgggtacagctatatgttaaatgacaacaagtcatttaacacagtactaggcacacagtaggcacttgacaaatactgatataaatgaatgaatgaaagcataccacctctcatttctttagtttctccatcaataaaatgaggttagtttcacagacagtgcatggctgtctcaaggattacatggagtgatgctgagaaagtggcttgtaagaagaggatttttataaaagcacttatttgtgcaagacaacacattttaaaaaatgctttcttggagttagaagagacgtatttcaaccaagggaaacatggaaggcttgtagtgaatagaatatatgaatgaaagttcaaaatatgaaaagtaggaatatgttttaacacagctgtttcataggccacttatgttcctgtggtgcttctgcaatccacttccttcacccaagagggcccagggtcatctcgctgcttagccaagcagcatgaataagagagcccccaggatgctggggaagaagtggtcttaggtattcatgtcataaaaactgggtagaatccttgctttctccaattgctggctgaatattctttgggaagtcacttcgcctgctttgagcctcagtctcctcacctgtaaaatagggtgaaattatccatatctcacaagttggtggtcaagactcagtgacacaatgataataataggcccagttcaatctttgctccctaaaaggtagcttctatttttgttattatagtaaccaaacatgccagtgggggcctcgggatggaggaggcctcaggcaaccctgctggggggtggagaaagaggaagacgtcaacctcacagtgctgggtcaaaagtcacaaggccatgcgctttctgcctgtctcagctgtaattgtagaactgttccagaggcacatctgaaagctgttaggggaccaggcagtgcctggaggggttacttgtgaaggagagaaagtggcagtccctgatatgaaggagagagggagaaagagacagagagagtgagaagttggggggggacagagaccaagaaacagatacaaatatataccacaagcaaatccatacagcaggagagtgaaagagggagagccagggacagagagagacagagacagagacagaggggagagggagagagagagagagatagagagagagagagagagagagagagagagagagagaataatcagacctctgagtttcttgagatcagaaagggtgtcagcctctctctgcttagttctgtcatcatctctctgaagcaggctgaggttcactgataatttgaactaaaactcctgtaccatcaactcctaatcttgattttacaagtggagaaaccaaagcccagaaggaaaaatgacttgcacaaagacccacttgccaatagattcatacaaagactctggcattcctgactcctcctcctccagtgctctctcctacatttccatgccctggctgatcgaggtccaagtctacttatgggatgctttcattatgaaagaggcggctcatggataacgttggatgagctatacaggaacctggagctccaggcccaaaccattgctattcctttccttggccttatttcaggggaaggaacactggccaaggtggctgaaacctgaatttgagtcccagcttgtccacagactgtgtggtatgagatcttgcatacctacagtaatacaggcttagtgtattgggaggttgaaatccaaacaaacacactgtgtgggaaaatgccttgggataactactccgaagtatttttcaatatttcttcatcattgtcaggacattgtcatcctcaggacatcatcttcatcatccttaggacaaagtccatcactctcaggacaaattcctcaacttggaaccccctcatttgagctctggtcaaaggtctaggtgtgcttgctgaccttcctccccactctgcttcacagcagaggcatctccagctgctgatggttccagaacatggatcccacctctgaacctttccaccagtggcactctctggctgagtcatccatccccttcttcacttgacccctctccaccttgtccttgaagcatcgctcaaaccttacctcctctggaaagtctgctttgaccgtctcaagagctgcttagccctccttttcccctgcacggtgcccatgccatatggtgcacatgtcacacagctaggtcagcaccccttcacttctttcttgcccctatgagtatgtgattgtcttcaggatcagaatatggttctgctcaactctaaacacctacacctggtgcaccaacgctcagcacacacaggtcagaatgaatgaggttcatttccctttcctggaaatcagtctttccatctgtgaaatgaacagaagatgactagattgaaaggttactaaaatgaatggaataacaagagggctaaaggcatggctttgggatcagccaatttgttgttaaattctggcttctcgtacattggctgtgtgtagccttgtctcaaggtactcacctgtacaacgggaatcataatattaaaactcaccatgaagggttcttgttagaataaaagagagtgcagcatgaaagtgctcagcacaatgcccgacatgtgatattgtgatatgcaataaccaatatgcaatcaatcgctgttggcatcatcattagggttagtactaagccactgcccaaggctctgacttcacccccaactggagtaagtggtcccagtggagatcagaggagggtgggtagaaaggaagctgctattggtcccatccaagaccccagacctcctcacagcaggggtgagagaatgaaaccaagaagttaattggcagtgagagcttctcacagatctgacagggggtaagagcagggacagagccctagaggcccacgtcaggcctgggtccccgagagtataggagaatgcgtttgaagtctccaggccaacgcctgctcttccccagccgcaacatgatttaggcattctggggaggcaaaagtctcctcgctgatttgaagggaaacagatgtttccaggccagaggccccagtcttgtaaaatgctccttccccccacacagctttggcaaacaacttccacttagctcatgcccacccctcccacccccactgccatggctcccctccctgccatttccagcacaatgtggcagacaggggcagtaggaaaagcacctagtcccagcttaagctttgggtctgggaagctggatggccagggccacctcagtgcccatctctatgcttcagcctcccatctcctgcagtgagggaacaggaccaagctcactgctgagagataggttagatctaatattctaggaactgagagctgttttttcctcgatagagctggtgttacacgttccagacttttctccactggattccgtggcaaacagcatggacttacaaataagactgttctggatttgaatctggattctacctgggcagtagcaagaagctactgagcaagtagaaattctaccattgagcctcagtttccttatctgtaaaatggggacaagagttttatcttgtgggattgtgagaatgaaatcagaatgcaatctccctacccatagtttaggtttcttgtgaacaaaatcaagtactatatcttttcccttgtactattcatgatgcccagacagtatggatgtagagaaaatgtgtaatagtgttcgtgatggatttttgatgggaagactgctagacactctgaagtccaaagcctctcattctgaacccagctccactcaagtagtagaaagagtgtttctgcttttatgatcacaatgaggcagggtgtgcagaggttagaatagacactggagccctgctacctgagttcgaatgtttgttctacaacctactatccttatgaccttaggcaagttaatcgaccttctctgttctgtaatgtttcttgtctttaaagtgtgtggccgggcgtggtggctcacaactgtagtcccagcactttgggagaccgaggcaggtggattgcatgagcccaggagttcaaaaccagtctgggcaacatggtgaaaccccatctctacaaaaaatacaaaaattagctgtgcatggtggtacacactggtagtcccagctactagggaggctgaggtgggaggatcatttgagcctgggagatcaaggctacagtgagccaagatggcaccactgcagtctagcctggccaagagagcgagaccctgcctctaaataaataaattagtaaaaataaaatgtgtatgataatattatctatctcaaagggatgttagaggaataaagtttatgaaacgatgcttgacacatggtaagtggtaagttagcataattgttattcaatgtgcatgtgtttaaataattcatctcttctataatggctttaaaacaagacccccgccccagttctttgacatttcaccttgaatatgggcaggctcatgagtgctttgaccagtagagcaaaatggaagggatgctgtgtgacttctgagtctgggtcataaaaggggatgcagctaccaccttgcttactgaaacattctcacttggaactgtgagcctccgtataagaaatttgagtgccctgaggccactgtggtgggaggaagacaagccacaaggagaggccatgtgtggttgcttcagcagccctggtacctaggctccagatggatgagtaaaggagccttcagataattctcacccaagcagtcaagttactcccagcttttgaattcttgcagttgaggccccatacttcgtggagcaaagacagcccaacctactatgtactgtctgaattttcaacccacagatccatgagcaaaatcaaatggtgattttaagctgctaagttttggggtcatttgttgtgtcatcaatagtaactgcaacaactaacaagcattgcaagcaggatcagcaaactacagcccacagtccaaatctggcccactgcctattttcataaataaatcttttacaaccacactcttttttggtttgctttgaatgcattttctatggctgctttcacactacaatggcagaatcacgtaattgtgacagaaatcacagcatcgtcaaggcctaaaatatttactatctggacctccagaggaaagcctactgactccaatgtagagctttgaaagtactgaatgtagtatcatttgcttacattatttcatttaatcccaaggttagaaatcattcctattttacagttaggatcagagagttcaagtgactggtccaaggtcacacagctctctaactgcaggtctaatgcctccatagcccgttgaagacctagactccagtttgagtaataatggctttgggtaagtcccaccatgctctgctctcactttcccagcctgggacatgagggtattgggcaagttgggctggagaggctgccaaaagtcagatgtccaaacttccccccagctgagtgctagctaccaagcaaagtatttctgttcccctttggtctaggagtacccaagtgaggcttgagaatgagtcaccaggggctgctatgcatccctgctcactctcacatgcagccacccaccctcgagcaccagaacccaactttcctgtctcccaactcaagctgacaacccatgctttctgccaacataaatatttaattctagtgcccggaacagagagaccatcttggtattaaggactcccatcctagtttctactttcaaaacaactcagtctgaggcatgattaggaggtcctggcttagaacaaaggtaaagcagtttgtggttgggctccaaacaccagctccccacacttgcactcccttcaacctctcaagctgtatgagctaacaggcaaagaatcaggggagtggggagctggcagggagagctctgtaggaaggccaagtctggaaaccagtgttggttctaagctcaggcagaggtgacagcaacctggaaacggtgctaggcatccactgttctgactgctaaatcccctgaaattcactggtatgtgagcatctccctaaaattcacagtgcagtgaacaccagaactcagaaataattatagtattaacacttaaaattaaatacatataaattcatttacaattaaagtgtgttgagtgtatctccaatacctgaggagtgagtaattatcacagcagttccactctgtgtgctttgccataaatgaatgcctactaggtgctgggcattctgctaagcacggaagaaacacccataaaaaaaaaaagagtggggtttttgctgtcatggagctcacagaagagcagagagatggtcaaatgaacaagaaatgggacacagtactataaggtcttcaataaaaatgtattcttgcccctatgtttgtttcaggtgtgtctgttcttccttctttcaaaacagtggactaagccttagatatgagtttaaaagctactgtgaactagaccttatcttgctggatcttctgtctgctgcaaactgggattgtcaaccacctacaggactctcatttttttgtacgaaaaaatgatgacaattcttgccctctccattctgaaagcctttgaggagtgaataagacagtggatttaaatatataaatactatgcaaatgatctgagtgtattcattcactcatcaaatatgagtgacctgacccctcttgaaaaaaaaaaatgcaggttggcatgtggcttggctttaacaacaatgactgtgtttgcctttcttttcttggtcttctcctgtcccttcctctccccatcccccgtcttttcctcctccttctctttattcagggtgtggactaaatgataacacataattgtactagctatagtacttaattggaagatgttcacattttaatatgctgttttagggtaaagcagacacagactaaccttatggtctcaagttaaggaatgaattgaacacagaatgcccaattattctactccaacttgcactcctgggatctctgaagcaaattgtaggcttttaaaaatatctttattatatattggacagcatctctgaactcagatataaacaataatttttaaagtgacttcagttatagaaatgactttttcagaaggcataacttggaagcatgttgaattgagaggcagaggatatgatgtgtaggtttcaccttgtcattaactagctatgtggctttggtgggattgtttgccctctctgcacctcagtggcctgtcaataaccccatggtgacggtgtgaggactaaatggtgattatggatgtaaaagtgccttagagattccacacacatttcctgggcacatactctgtatcagacacagtgctagaagcttttacacagttgtcttctgtttcctttacaactgcctaagggatgtgtattattaaatccattttacaaggaggcaagtgagccttggaaatttggattgactttcccaaggctacagatatagtagtagtttagccaggccccaacataggtctacttactcaaagtccactgctctttccaaatggataaaattattaggcattcattggtcccaagtgggtcttgagtcacagttcagaggaagttaaagtttattaggaggatgaactccatgttcccaacttttgacaaggaagagatcttacaacaggaacacactactgctcctttcaacactgacatcacttctcttcccacatctgaccctaaagcccttctcttcttccatggtgcctttaagattgaattttgccaaagccaagctcagaggaggagaggccaagcagaggccaccaacttggatttactcttggccattaagttagggaacattataggcagaatggttcttatctactcagttctgagctgagctcagttcccatctcatatgtgagttctgctttccatgggtggaggggtgggagtgggacaaagaaacaagccctctgcttggggtctaaaagactgagtttgcatcatgactttctccatttcctgtttctaacatctctgagagtcttagttttcctatctgtaaaatggagtcaacaatacttgcctcacaagattgttgtaagaatgaatagcgctgggcgtggtggctcacgcctgtaatcctagcactttgggaggcagaggcgggtggatcacgaggtcaggagatcgagaccatcctggctaacacggtgaaaccccgtctctattaaaaatacaaaaaaattagctgggcgtggtggcgggtgcctgtagtcccagctacttgggaggctgaggtggaagaatgatgtgaacccaggaggtggagcttgcagcgagctgagatcatgccattgcactccagcctgggcaaaagtgcgagactccgtctcaaaaaaaaaaaaaaaaaaaaaaaaaaagaatgaatagcatgagaaacacccagaacagtgcttggtacaataaatgttatcttgcttatcttgcttacttatgatactcaagtaagataaaatggaaacagtgcatctttaaaatcaaatccctgcacaaaggcaatggttctggagggtgttgtttttcataaggtttcattagagctccagttcagccacagcatgtataagcaaatcatgccatgtttgtgagcttcagtttcctcatcagttaccccatgacagcaatatccacttttgatcatagttaagaaaactagaaacaatttacacactaggcactggctcagctggagcctgaactcagggctgcctgttgtgaccttgggtgaatttctgccccatggactttgctttcttttcctatttcacaatgggtcactagatgtcttcactggtgaatgatagcaaatgttaactccagctagcgccaatcttctgcaagctcttccaacaagacaaaggaagagggaacactgacaatgaattctataaggtggtgttatcattatagaatttgtctgattaaaatcagatgaaatccaatatcccttatatagatacaacagaatactaaactaaccatactgaacaactataaaaaagactataccctatgacaaagtagaatttgataacagagatatcaaagtagaaatagataatagagatatctatttttaccctttctattccatattgtactgaaggttctagacaagacaattcatcaaggaaaaaaaaaagcatccagataatgtggagaaataggaacacttttacactgttggtgggactgtaaactagttcaaccattgtggaagacagtgtggtgattcctcaaggatctagaactagaaataccatttgacccagccatcccattacatacccaaatgattataaatcatgctgctataaaggcacatacacatatgtttattgtggcactattcacgatagcaaagacttgcaaccaacccaaatgtccatcaatgatagactggattaagaaaatgtggcacatatataccatggaatactatgcagccataaaaaaggatgagttcatgtcctttgtagggacatggacaaagctggaaaccatcattctgagcaaactatcgcaaggacagaaaaccaagcatcgcatgttctcactcataggtgggaattgaacaataagaacacttggacacagggtggggatcatcacacactggggcctgtcgtggtgtgggggaagagggagggatagcattaggagatatacctaatgcaaatgaaaagttaatgggtgcagcacaccaacatggcacatgtatacatatgtaacaaacctgcacattgtgcacatgtaccctagaaattaaagtataataataaaaaaaaaaaaggtttatggtaggaggctggacacagtggctcacgcccataatcccagcactttgggaggccaagggaggtggatcacctgaggtcaggagttcgagaccagcctggccaacatggtgaaaccctgtctctactgaaaatacaaaaattagctgggtgtggtgacgcacgtctgtaatcccagctactcagaaggctgaggcaggagaattgcttgaacctgggaggcggaggttgcagtgagctgagattgtgccactgcattccagcctgggtgacagagtgcgattctgtctcaaaaaaaaaaaaaaaaagaaaagaaaagaaaaacagtttacggtaggaagtaatagttaattgctaatttttaaaacccatgtgacattttctttactacaaattatttaagttgtaagattattaaattttcagtttaatactagtgtccaaaaagaaataagaaaatcaacaatataaacataagactattctcatgtcacttccaaaagatattatttgggcaaaatgatcaatgactacataattttgaaaaggtgtcaataacctcttcttagattgaagaaaaaggtaatttggaaaattccctgaaagtactactactggtaaactctgagtttactttaacagcaacaataaaaaaggcccaagccatccttaaaatctaaaaagtaaaaaaaaaatagcatccagataagaaaaaaaaaagtaatacaatctatttttgtagagacataattttatatatggaaaataaaaaggagtccataaaatattagatataaaacagttcatagttcaacacaataaaactatatacaatagacacacagctagtattataccaaatggggaaaaacaaaaagcctttcctttaagatctggaacaagaaagtgatgcccactctcatcactgttactcaacatagtactagaagcctagctagagaaatcaggtaagagaaagaaataatgggcatctaaattggaaaaaatgaagtcaaattatccttatttgcagatgatatgatcttatatttgaagacacctaagattccaccaagaaaaaaactattagaactgacaaaatcaggaaagttgtaggatacaaaatcaacatacaaaataagtagcatttctacatgccaataatgaacagtctgaaaaagaaacgaagaaaggaatcccgtttacaatagctacaaataaaatggaataaatttaactgaagaagtgaaatatttctacaaaaaaatataaaacattgagtcaagaaattgaagaggacacacaaaaataggaaagataatccatgttcatggattgaaagaataaaaaaaatccatattacccaaagcaatctatagattcaatgcaatccctagcaaaataccaatgacatttgtattagtccattttcatgctgctgataaggacatacctgagactgggaagaaaaagaggtttaatggacttacagttccacatgtctggggaggtttcacaatcatggtggaaagtaaggtggagcaagtcacatcttacagggatggcagcaggcaaagagagaggtgaactcgtgcagggaaatctctttttataaaatgatcaaatcttgtgagacttattcactatcatgagaacagcacacgaaagaatttcccccatgattcaattatctcccactggttccctcctacaatacatggaaattcaagatgagatttgggtggggacatggccaaaccatatcaacattgttcagataaatagaaaacaaatcctaaaattcctgtgaaaccaccaaagacacaaaatagccaaagctatcctgagcagagagaacaaaactggaggaatcacattacctaacttcaaattatactacagagctatagtaaccaaaactgcatggtactgtcataaaaacagacacatatatcaacagaatagaatacagaactcagaaataaatccacacatccacagttaactcattttcaacaaaggtgccaagaacacacattggggaaggaacagtctcttcagtaaatggtgctgagaaaactgggtatccatatatcaaagaaagaaactagagtgctatcttttaccatatgcaaaaatcaaatcaaaataattaaaaaagttacatctaagacctcatattacgaaactactacaagaaaacactggggaaactctccaggacattggtctgagcaaagatttcttgagtaatagcccaaaagtataggcaaccaaagaaaaaaatgaacaaatgggatgatatcaagtgaaaactgcacagcaaaggaaacaatcaataaggtgaaagacagcccacagaatgggagaaaatatttgcaagctatccatctgacaagggattaataaccagaatatataaggagctcaaacaactcaataccaaaaagattctaataaccccatttaaaaatgggcaaaagatctgaatagacatttctcaaaagaagacatacaaatggcaaacaggtatataagtaagtgctcaacatcattgatcatcagagaaatgcaaatcaaaactacaatgagatgtcatctcaccccagttaaaatggcttttatccaaaagtcaggcaataacaaatgctgacaaagatgtggagaaagggaaaccctcgtatgttactggtggaaatgtaaattaatacgaccactatggggaacaatatggagattcctcaaaacactaaagctagaactaccatatgatccggctatccaaggaaaggtatacacccaaaagaaaggaaatcagtatattgaagagacatctgtactcccatgtttatttcagcactattcacaatagccaagatgtggaaacaacctgtgtccatcaacagactaatggataaagaaaatgtggtacatatacacaatggagtagtattcagccattaaaaaaaatgagatcttaccattagaaacaacatggatggaactggaggacattatgttaagtgaaataagccaggcacagaaagacaaactttgcatgttctcactcatttgtgagaactaaaattaaaaacaaaaaaaaaattgaactaatcgagctagaggatagaatgatagttgttatcagaggctaggaagggcagtggagaagaaggggaaaagaggggttggttaataggcacaaaaatataattagataaaatgaataacatctagtatttgatagcaaaagagagtgactacagtcaacaatttactgtatatttaaaataactaaaagagcataattgaaaagttcataacacaaagaaataataaatgcttgaggtgatggattcctcatttaccctgatgtgattattacacatcgcatacttgtatcaaaatatctcatgtacctcataaatatatacacctactatgtacccataaaaattcgaaataaaaaaaattaaaaaataagttcagtcaagcaggttacaagattaatatacaaaaatcaactgtatttctatttactagcaatgaacaatcagaaaataaaatttgaaaaccattcctttgtgcagtattaaaaactgtatttacagaattaaaaaaaacacttaggaataaatttaacaaaagaagcataagacttgaacactaaaaactacagaatatcattcaaagaaattaaagaaggcctgtgtaaatgtgaagacatcctgtattcatggactggaaggcttaacactgttaaactggaaatattcccaaatttatctgtagattcaaaatctctattaaaatatccgatgatttgttttacagaaattgacaagctgctcctaaaattcacatggaaatgaaaggcatccagaatagccaaaacaatatttaaaaagaaaaaaaagctggagtacttatacattctgatttcaaaatttattacagagctatggtaatcaagactgtgagacaccagtatgaggacagatgtagatcaatgaaataaaattgacagcccagaaataaactcatacatttatggtcaattgtttttcaaggagggtgccaagaaaatacagtggggacagaatactctctgtaacaaaagactctttatcaaatggaacacttgggtagcctcgtcaagtgaataaagtgggacccctatatcacaccatgtataaaaattaaaataggtcattaaagacctaaatgtaaaggctaaaactataaaactgtaagaagaagacataagagaaaatctttaagaccttggattaggcagtagttttcttggatattacattaaaagcataagcaaacaaaaaacatacataaattggactttatcaaaatttaaaacttttgtgcctcaaagaacactatcaaaaaagtcaaaagacaactcataaaattagataaaatgtttacagatttcatatctcataaaggtgtcatgtctagaatatataaagtagcattacaactgaacaatttacgaagcacaatttaaaaatggacaaaagatttagacatttctctaaaaaaaagacattcaaatggctaataagcacatgaaaatatgcttgacatcatgttattaggagaatgcaaataaaaaccacaatgagacaccacttcatacccactaaaatagcgatagtcaaaaagacacaaaatagcaagtgttagcaaggatatggagaaattgaaatcctcatatattggtggtggaaatgcagaacggtgcagccatattggaaaacagtttggtagttcctctcaaagttacacacagagttatcatatgacccagcaattccattccaagctatctaaccaagagaactgaaaacgtatctccacagaaagacttgcataaaaattttcatagcaacattattcacaacagccaaaaagtgaaaaatgacccaatatccatcaactgatgaatgaataaacgaaaggtggtatatctaaataactgaatattacttgccataaaaaggaatgaagtccttattcaagctacaatattcactgagccttgaaaacatgctaagtgaaagaatccagacacaaaggacatatattgcatgattccacttatatgaaatgtccacaataggcaaattcctagagataaaaagtagattagtggttgccaggggttgggaggaaggggcaatggaaatgactgttaatgggttacagagtttctttttcgggtgatgaaaatgttctggaattacttgtgatggttgtgcaactttgttaatatctataacataaaatccactgaattgtagccttaaaaaggtgaatttcatggtatgtgaattatatgtcaaacaaacagaaaaaccaaaaccagtggagtcaggaggatcctgcctcgttaatgatggcatggttctcctttatctttagcttttttatttttgagtttgagcaacatctcccaccccaaccctttgcgcgtatttcctcatttaagtagaaagtgttacttatagaggaaatatggaaccttcagtgaaatcttaagtgaatagctatggctttttaaaatttgtaaatgtaggatccgaggattgcaaaggaactatatggtgcagagtttagggtcatggatgtataagcggggaaagttctttgtttaaagatggtctctgctgcttgcaggcttgtgacactgggtgagtacttggtctcctccagccttagtttctttgtcagtaaaataaacagagttccatctgccacactgggctgttaggaggattctgtagcgtagataagatgcccttagcccatttcttaacaaatggtaacagcacaatacatagttattatagaacaaccattcttaatgatcctcatcagcatttcctattttttggctaaacagaaataattgtattcaatctagtgggggaattcaccttgaacctctggcatgttcccaataatgtgcacatcctcctctctctgcctggaataatttctccccagttccttccctcacctccttttccatgaagttccctttttaaattttgaccataccccaaatggtacatttcaaatacaatttacccagctttatttttccttcacaagatttataatcttctaatatattatataatttacttatttattatatttattgattttattttccactcccacttgaatacaaaattcatgagaacaggatttagtctgttttattcactaatatatccccagtgccaaaaattgtgccagaccacatagtaggacctcaaaaactgttctttgaatatatgtgtgtgtaaaatacacatatttatatacatgtatacgcatatatatatgtacacatatataggtgtatacttgtttatatgtacacacatgcacacacacatataaaaatctgtgcacctagattgtggtctctcctacataaaagctatccatggcatctcactcctagaatattatttcttccctcttcatctgggaccatgtgatttttttccatccagtgaactgtgggttaagatttcgtatgccttctccagccttctcttcccatctcataggccaatgtattccagaaggtatattcatgattcaatagagggcctccatcagtgtggatccctgagtgactgttggaatagagcttcctgccaacctgtagtaggtatgtccagtgagtgacgattaatgctttgttatgttatgcactaaagtttttgtgttaactcagcatagcttagcctatcctgacttacgcatgcctcattcacagatggacgacaacagtgagaaacccattctagaactattgatcacacaaccatgtattttgcacatattttaggtcaggcatcttgcaaggagctttaaatgaattgcctctgatcctcatgttggcctgttaaataatggttattatcaccattttataattgaagaaactaaagctctggtttggcatgatttgcccaagctcatccaaccggtaattggcaagccagggtttaaacccaagcctgattctaaagaccactctctttctgctacaatttgagcccccatgggacatttttaaaatgtcctcatatgtaaaacctttgaactgatgaagcacatataatgtgctaggaggctatctaacttcaccacaatcccatgaagtaggttttatcattgtcttccttttacacaggaagaaatgggagcacagtgagcttcagcaacttgcccagtatgtcctggctaggatatacagagcaatgattcaaacccaaacagcttggcttcagagccagggctcttaaccttctgccatgctacatctcaattctttgggaatccctgtcttaatccatgccatgcaataataatcctgtattcttcttgaaaagtacagagaaaggagaatttcttgccttacaaggggcaggtgtagaaaaatcaccaggattatactgtggaataaagaatgtctgaaatgaaagttcaatgctttactctaaactcactgttgactccctgactcttcaagccgataagctcaaagaggtcagtaggtttggtgataatataggaacgatgggataatattcttttccttgggttaagggaagttctagctttttacctcaacaggccttcttatcctcctaggattgctctttaagggtaagtgttgggtgagcatgtgtgtgtgtgtgtgtgtgtgtgtgtgtgtgtgtgtgtgtgtctgcccatatatacaatttgcatatggcaatctgaagtaaatttctaactaatattacctgctagtcactggatatctcctttggatgtccaaagacatcttaatctcctgccttcacactcctcacatcccccaaaactgttcttcctgtcatcctccccatcatggtgaatggcagcagcatccatttagtcactcagtcatgccctgggtatcatccccaacccttccctctgtctcactcccatattcaatcagtttccaagttctattaagtctatacttcaacaatttctcaaatgtacccgcctttttctccattgcaactgctctagttcaggctgcaaccatttctcacccggccaattagaaccatctcccaaccagtctctcaggcttctcccttacatcccacaccaccctaatctgttcatcacacttctccaagggtctttttctgaaatggttatccagtgctgtcctacctcaaagctcttcgatctctccccaccatccataacataaaaactattctccctaagctggttcacaaagggatttgacatcaggactttatctcctaactcctgccatcctcctctcaacttctcagccttcattatatgcttcagcaataccaaacaacatattgtttctcaagcatgccattgtccctcagcctatgggcttttgctgtgtccctgctgaatgttctctctgcctataatgcctgtcacctctctggggcacttccattccttcacatgtccctccctctgggaagccttctctgacagttgaattaaactaatgtaaggggtatagttttagtatggaaaagaagacagctccctctcctgtgcttttcttagtgtcttgcaaataacttcattatagttacattgtgtttcctactctatcttctccactacgctgtgagctcctgaaaggccagggctgcatgttatctgtctgtttgttttcttgagacagggcctcagggtcttgcaatcctgctacctcaacccttgagtagctgggatcacaggtgcatgccaccatgaacagagttttgtgtttttttttttttttttttgagagagacagggtttcattatgttgtccaggctggccttgaactcctagtctcaagtgatcttcccacctcggcctcccaaagtgctgagattaaaggtgccagccaccattctcagccatttctgtctctatatagccagaatctgacacatagcagaggagtattaaagatatgttgaataagtaaacaaattaatggttgaatgtatatttgtcagtgtgtggacattatgacaaatgtcataatgtatagctatataaacaaatatatatatatatctgtatgtctgaggctgtgtatccctaagcctggtaataatatgggaggatgggtaagtgtggcacccatgtatgtgaagtggcaatgcagcacagagttatgcacttggttttctaagtcatatagatttttgtgaggattatttgtttgctattcactaattgtgatttgaacacaatagcatcatctctctaggactcacttccatcaatggtaatgcatagatattgatgttactagtgtcctggaatcattgtaaaatactagtaaaggcttagcagagtgactggcccacagcattcaatatgttggttataattatcttccttgagagcagttatgtggtccattcatgtatggatgtttgtgctgaagcatatccctgagtattgagtattcatgtagctgtgtgcatgttgcatatatgggagtgggggtagaatatgagaaactgcatgactaacatattgagttctgtgtgccagttgagtctccagagagcctttgtactgggcaattttgtttctgttttttgtttgtttcccatctcttactgctttgaagcttgctctctgggacacactgctggggtctctacttgcctatagggatcaacttaccatttcttcccatcaaccactcactgataagtaagtgtgaggcacaatgggtgcgatatgcctgatgtctattttcctaagaaacttgcaaagaaggtgcctcttcaacccaactgttgcagactatatgaagaggctcagagcaggtcactgcaggtctttccctgtagtcgttatggagggaatgacctagatatggacccggctctgtgcttctgcctaatgttaatagggaggatgtcacatttgagcatacccttagcacacctgcctgagatgtggcagagcacaagtttaaaatccaagtctgtctgcctccaccacgaaggctgcatactctctatcatgctgtcccttttcactacagccagcaggtttgattgttgctttgaactcaggcgaccctgtgcagcctttgtctaatatctcagagccccagccaccaaccggctccctttgccccatgaagataagcctttctggtcgactggacacatcagccttagaaaccttgagttaccagaatgggagcaactggctggctgggtacggttggggcatccggccctgataagacctcgccacggctggacaagctctcagagacgtaaggctttgcgtaagcacaagattagaagaacacattattaaaatatttattttcttacaggtattgattgacataaaaggggggaagagttcccaggagagagataacatccagtggtactttttgtgacttggttttgaacatatcgttatacagaaattaaattactattaataataaataataacaatacaagctgcaagttgtcagctggaagcagctgcagtttccatttgcttacatatgaaactaaggatcatggcgcaaatttaaaagtaagcaagcaaacaaacacaaacccactttgctctgcggattagactaatgcagattcaggagagtggctgtgttttaggcgagatgggaggggcagaatggggctgagaaggctacttgatgagtagtcttcaagtgtgtctttaatttcctttaggagaaaataaagagctctgaagcaaatgtgacagtactgacatgcagtaatcctgaataatgacacgtggtggcttattgtactttctccatactttattttatttcagtattcatgattaaaacaaatgaacacatccctgacacctatcaatttatactttgcaaagcgtattgcacaaataaccttgaaagcaagacaaagcagggtttattgcccacattttacattcagtgaacttgctgtttgcggggagggtgggaagcgggcttttgaatcaaggacgcatagtggaagagtgatagagctggtacttaatcaactgctggtccagggctccttatgctgcattcaccttgactttgaagacaaaactgttccccctcttgcagaaaaatctctgtgaggtttgcattggtccaaggactaagacagcattaaggcacttcagatctctagcttcttggccagtccagccaccttctcttatctctgctctgcaacaatgagtcttgacgtcattggctcagcaaacgtttctcaaaggctagatatgaggctggaacttctaggcagttccttacagcagcctgcttcacaattcctaccagcccattctctctgtgaccttcctcacctattctcttttcataaatttggttgctgcctccaagtagggttttctaccttcccacaccttcctcagacagaacatccagtgtaagatgaggcaatgcagggcagaagttcaggtccagagttttggcatcagaatgacctagatatggacccggctttgtgcttctgcccagtgttaatagggaggatgtcacatttgagcatacccttagagaataaatatgtgttaggtaaataaaggcaggaggaggtcatgcctggtgctaaaaacttccttgttctcccaagcttttttttctccataacccatgatttgtggggcttctgttttctcatctgtagaatggggataataagactctgagaataacattttttgctatcagttttgtttgttttccttacccagacattgttacgccttcttttggaagcatggtacctatagccactgacgaactatttctgcagttctcaatgtggtttgggtgggactgttcctctcatgttcctgcctctcaccagaggagtggtgacatcagccaagcaaggcagcaagagtcccttcttgaggattgataggggtgctggaaaaggggtttggtgtgtttctttctttctgagattaaaagcatgaaggactatcaaagtctacagttgctaggttccatcttcatacccctcataaggaaaactcactttagaatgcagccagcacacagcaaacttgaggaaagagatagagagagagagagtccttttttttcttcttttgagacagagtctcgctctgtcaccaggctggagtgcagtggtgcgatcttggctcactgcaacctccccctcccgggttcaagcaattctcctgcttcagcctcccaagtagctgggactacaggcgcacgccaccacttccagctaatttttgtatttttaatagagacaaggtttcaccatgttggccaggatggtctcaatctcttgacctcgtgatccgcctgcctcagcctcccaaagtgctcggattacaggcgtaagccactgcacccggccgagacagaatcttacgacgtcatttgaactcctggattcagctggggctgaagtcagcacactgttagacttcccagttatataagcagatacattctattttccttaacaactttcatttgagtttctgtccgttgcctccaagagtctaaactcatgtaaatatcctttataaagttgttgtgatgattaaacaagataatgtttttaaatcacacattaaacttaatatctggcacatttctaaatattcaagaaatggtagggtaggtagttgttatcattagcaggactgtagtgaactcttttcccagaatgaagtttgctcctacgattggctctgcagctcagcctagtgatgagcaaacaaaacctctgtcactgcctggccacacaacgttggctaggtctctttctacctggtgcagaaccaaatttccaggctctgggaaagacccatacctgttcagaaaggactagcttctcattcctctgagtgtcagtactgaggacatgaagccgtgaatgacactatcattatcaatactttacttgctgttatccccactggaatgtgaggtttctggggaaagaaaccacaactcattcttctttcaaccctgctagcctctcatatactagtggcactcccaaaggctttctttcctttttcagaaagagatgagagctaattacctataaaaattagtaaggaagaaatggggacttttgccaactcaaataggcttacttattgtttatcctccacaggacagttatagtacataggacgtgttaggagaaagtttcctggttgtcaccagtactactctaccttgggcccacctaagaggcaaggaattggagtagagttcttaccaaccagcatcaggaaggatgctcatgtacacagaggaattgtctgtggctcatctctcaccctctgttaatctgacactgaagattttaatctcccttctttcttccaactcttgcctacactagccctcactggctctcatccaggctttgggaacagcttcccaaattacttcctatagttttgtcacacctctaatctgttgctagtgtattagccagagtgatcttcctaaagagcaaatctgacaatgtcaactgagcagccggctcatgacccttaatagctctctttactttcaagataaagtccacactccttaggttggcaaaatagtcccttatgatttgagctctaccaacttctttcatcatccgaatttgttcctttgcaccataataacttgagtaggggttgcaaatgtgccatgttgccttgcttctcagtaactttgcacatatgacctcctcttcttggaaaatcatgtttccttttcttggtatctgcatcttagtaattctgatcattctttaaaacttaaataaaatgtcatcctttctaggcagctttcactgggctgaaaggcattctctcgtctgaactctcatatcattgaccacatttcatcgtgagttccatggaagcagagacaatgtctcgttcatctctgggttccaagaatgtagtgctgagttgtacagagaaaaaggtactcaaaaactaatagaataaacaaacgttaaatgttaatagggagggtgtcacatttaaacatacccttagagaataaatgtgtgttggataaataaaggcagaaggaagtcatcctggctgctaaaaacttccttgctctctcaagtggttttttttttccatagtccatgatctatatgacgtcatagaaccagttcaccaatttcaattggcttgtggtatagtggtttatgtatacaactggctcctcccagcagaatagagaactttttagggcaaaccctgcctcattcccctgtgccccttataaagctcagcaggagggaatatagttcagcgggtcagagcctgagctctgaggtcggtcagaaaagacctgctttcaaatgctagttctgccacttattccctcagtgactttggccaatttattgaaccttcatgagccttcatttcttcatctctaaagtgagaggggaaaagtatctgcctaataattctagctatgctaaaatgtgatattgcatatattcacttatgtatacaatacatacttattgagtgtctctgtgtttgtgcaattgagtgtacacagataaaacaaacactataccccataaactgtcaagtctaacagggaacgttaatacacacataaatctgtattgtaatgtttgataattgcaataaagaaaggaggtgaggtacataatttagattatgggttctggggatgccattctgaggatgtagatttaggctgaggctgggcacggtggctcacgtctgtaatcacagcactttaggaggccgaggtggcaggatcacctgaggtcaggagttcgagaccagcctgaccaacatggcaaaacccgcctctactaaaaatacaaaaattagctgggcatggtggtgggcacctgtaatcccagctactcaggaggctgagccaggagaattgcttgaactggggaggcagaggttgcagtgagccaagatcacaccactgcactccagcctgggtgacagagcgagacaccatatcaaaaataaaaataaaaaataaaaaaaataaaaagatttaggctgaacactgaaggatgaatagtgttaacccagggaaaagattcggcgtgttctgaggccctgtgaaggggaagagcgcatgctgtggtgtgagctaggctccttaaatgctaatgtgacttctggggatgctggatcagttaataactaggaagttagactctagagacaaactgtctgagttcacatcctggctctgctactgacttgtggcatggcttttggtaaatttttttgacttctttgggctttggttttctcatctgcaaaatagtgataataaaaaaacactgtctcattgagaagggtggatggattaacttacagaaattatttagaatggtgcctggtatattgaaagcactctttatataatagccattcatatcattgattcttttatttgcactccaaagtatttacatgaacactcttcactgaagagaaggcaaaagtcctacctgaagaaagcatattcatattgtggagtgaagatgaataagggaaattatgggaagttaaataaagtccaataaagcacccagaactcatttgtcctctctgtaaatggcatgattcttgcctctaaaaatggcatatttcataatgccaatgctttatggtgggtactctccttggcctgccattggttacctacattgggacaagggtattgagattcctggaagaaagttataactctaagacgatgtattgttcaaaaattaacaagactaaagcaaaaacaaacaaatgaaaaatctctggggtttcctctcctttttcttttttaaaatgattttttaaattgatttaatatctgtgtagaagccagcaaaattgctgtttacttatcctgtagcttctgagtgtcttctttgcccctttgctctctctcttccccctgttacaggctatagatatgattaagaaagatctatgtaatggtgttaagttactacactctttggaggagagatttctggggacaggcctgcgataagggtgagaggagttggatccagtcgtgagagtcagataggcagctcacccacacacaacctctccacaagcgagacagcttcccggcctttcttgcttgttttaatctgtgaatgtttcccagaaagaaatagtaacttctttttctggcaggggtgcctcctgaaactccctgaaaacagggcctctccctccccttcaggctggcctcacacatgctaatgcaaatcagtcctgacccagccaggggtctttgggaaggctgccaggagctttagaacaaacacgcgaagaatgttatttcatttctggcatcccggggaaagagggacagagaaggaagttgggcagtaaagggggtggagggaggggggaattcatatgaatgcttactgcaataagagtgaagcaaatggaaaggacagcaggaaattcttaggaataaagggcctactaggtgccagaaatggacatatggaatatttggttttaatttcacacatacactctgaagaagaatttattactctcactttttggatgcaggaagaggcttggtctccaaggttaggcaatttttcaaaggctacccagctaagaactgagggagtcagaatttgaaaccagatttttacatttcaaaccttgggctctgtcttctcactaaggctggcttactggttgtgctttgatagattcccaacaaaacccgcgagtgcaacagccccacatgccatgacctccatcgtctgtctcctcctttccagccccctgcatggttctaattccagattcattcagccagaccccgagctagtctccctacctgcagtctcctctattctaacttatacaccacgaagatctttctataacccaactgtggccttatcactgctcctccttagcacacgttatgaggccttgcaagtcctgcctctccaacctcatatactgtacatttcaactgccctgaatctctgttgtaccccatatgtggtcccttcaatatcctacctccctgccttcatttcagctattccttctgcctgtgatgcaataacttccccagttctaagtgttcaatgctatccattcttccagacctagctcaaaggcacctccccaaaggcacactagctgttagagatcacagcctcctcagaactcgcatgcctttattatggggcaaatcaccttctacccccaatatgattagctgcttaaaagtttgtccctaacactgggcaaagctctttcagtctcagccataagactttgaattgcagcttggtcactgcctaagagagaagtgcataagaatacacaagtgcagattttggagctagatagcttgtgttagaatcatggttctggccaggcgtggtagctcatacctgtaatcccagcaccttgggaggctgaggcaggcagatcatttgaggtcaggagttcaagaccagcctggccgacatagcaaaacccagtctctactaaaaatacaaaaaaaaaaaaaatagccatgttggtggtggcggcggcggagggggcacacctgtaattccagctactcaggaggctgaggcaggagaatcgcttgaacccgggaggtggagtttgcagtgagctgagattgtgccactgcactccagcctgggcaacagagcgagactctgtcttggaaaaaaaaaaaaaaaaagaatcatggttctgccatttactaataagatgaccttgggcaaaccattaagccttcccatcttagtttccttgcctgtaaaatagggatagtatctaccttagagggtaccatattattaaggttcaaagagttagtggaccaaaagactttgcataatgaatggcatgtaatagagtttgataaatggtacatgatgacaacgactgggaggcaggaaccatgttcttggctgatagctacactgcatacatgacagactgtcttcattcattcaacctgtaatacctattatcgatctttgatgtttgctaaattaagtacctactaagtgccaggccatatgttatggatttacaggtaactaaaccatggtttctaaaacctattctactcttagattacagacagttttcattctttatgataaagagaaacattataggttcaaggaatagtagaataaaaagagagggaggaaaggcatctcttgttacgtcagatgatgggggaaaacaatccaaactagccagatcccatgtccaaagggcttctgggaaatgctcaggaacagaaaaacgtgagtaactgcacagtgggcaggacaattagccaagcatgagtccccttcaaggtcatcatttcagttggcagataaagacctattcaaggccaggtgtggtggctcatgcctgtaatcccagcactttgggaggccaaggcagacggatcacctgacgtcaggagttcgagaccagcccagctgggccaacatggcaaaatgccgtctctactaaaaatacaaaaattagctgggcgtgttggtgggcacctgtaacccagctactcgggaggctgaggcaggagaatcgcttgaacccaggaagcggaggttgcagtgggctgagatcgcaccactgcactctagtctgggcaacagagcaagactctatctcaaaaaaaaaaaaagacctactcaagaaagatcttatatgtacttggtatgtgtttaatattgttctggacaccctatgcttgggagctctgcatgtgtatttgtttcacaacaaaattctaacatggaaaatggcaataccctcactgtacagatatagaaattgagacccaggagaaataagcatcttgtacagccagaaactgtctgagatttgaaatgaccctagaatagtctgactcaagaccccatgctcgtagactctcagatacccaagaggatcggggcagatgggtgcttgaatctagtaccagagagcagcaggtaggctataacggaggtgaagagtcctggttcagcccagctctgctctgcctgtctgggtgacctgggtcaagccctatctcctccctgggctttagtttttcccataaagagagagggtttagatcagtggtgtttgcagtctcactatcctgtgattcaaatatgaaagtggaatagggttgttggtggatgggggtctgtctttggaggaaaggagaacagagcagcaagaaaaatgccagaagtctggattccgtctcacctctgactctctacacatcattaatggtaatccctgcagtccactaacacctttccagtgatgactcaagactgctcacaacctccttcacagatggagatgggcatagggggaaggcagccccttcatgtgcagtgatggacccacagccaagataatgagagcagggaaaagttaggaagcctggcctctagcctggtttcattcctagagtcttaaatgatcagagtagaaatgaacttctctatctgagcccctcattgcaatgaaaaagaaactgaggatcagaaaaatgaagttctttgcccaaggccccaggtggatggacagcaaagctgggcatgcagcctaggtggggcttgtgatcccactccagaagcctctccctatgttgaactaactgggtactttgttcctgacaaggaaccctaaagtagaaagtgatggtcacagcctactggtaaaagacagaagtcagaagtcaggattcccatgtatcattcctggctctgccttgactatgatgccagagtctcttggggtctcagcttcctcatctatacactgagagaagtggcctagataagagttcccaaattaatgatctgctggttgttacctacaaaattggtttatttggccaattttaaattggttgccagcatgtaataattaggaggtttcacataaacatctagatttctggcttggaagatgtattaacaccaaatcagcagtctcaaatggtaaccagcagctggaactaagtattctctgtgccatgcctaatttactgcagtcctcactcctccctattatcaagcatctggccacaatgactcattgccatcactggcaagttcctccttacaaagcatggcttagagtttgcctcatccctaacagctccctgctgccctgagcatggggctctcactgcccaccgagacttccagcccactgaaggccagtaatagaacatttcctgtagtgatccaaaatcaatctgccttatagccttgtaccactgtcctgctctctggagtcacagtgaacacatctgtgccctgtacccctgtgcagctctacagagggttgaagacattgggtgcacccttttgtgtcttttcttaacttgaataaacattcaaggtcactcaagcgttcttcatggtcatcatttcaagggcctcggggacctgcttcctctcctctaggcattgttcagatgcttggccttccccttgcaagtcaactctttcctgcagcaatgaagctcattcatcccaccaactccctggaagcttccccatactcctcatggagcccaacttggatgatgaggtcctcgcctgcctccatagccccaaatctcctactttccctggccttccacattccagttacactctctgctgcagcgttgtctctcgtcccccagcctgctcacagtctgtcctctgtcccaaatcctcttttccctcatattagtttcttagggctaccattaaaagggcaccacaaatttggtggcttaaaacaacagaagtgtactctctcagagttctagaggctagacgtgtgaaatcatggcatccgcagggccatgcttcctctgaaggctcttggaaagaatccttccttgccactctcagcttcggatggcccgaggtgttccttggcttgaggcggcatcactctaatctcagcctctgtcttcacatgccttctttgctctgtcttctcagagcggcatcagtcactgaattaaggaattaacttaatccagtattacctcatcttgatccttaagtaaatacatctgcaaagatgatttccaaataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccctcctggctctcaactcaactcagcctgttctccaaaccatggtcagggttgtcaccacaaaacacaggttaagatacatcctgtccctcctccagtgcccttcctggctcccctctgcctgcaggagaaagcccagctcccctccgcctgcaggagaaagcccagctcctctgctcagtattcaaggcttagccctccagcgcagcctcagctcccaccccctccccactccacaaggtcacatgagcagtctgtgccctgtccctctggaaccctggctggtgtcccattcctggatggaatcttgacgcagtgtgaggaaagaaacagcctgcttgagagtccccagcaggttttaggagcctcactgtctgtcggctgaaaaacagcgttatttttcctctacgagtctctcttggcttgggatgcacggctgtatttgcttctggcttgaggacagctattcccctctcccaggccccaactgtgcactttggagaggtcagtacgacctgatgttagatggaattgagtcgccaggctgccgtacttgcccccatcccctaaccaattaggactggacaccacagccaagggaagttcacattccactcgagtttggggacatcagtcacccccgtccctactgagctccgagacccttggccacacctaaattgccattcagcccagaatcagataataggcagaaatccttgtacttaggctggtgtgggctgtttgggtgtcggaggaggaaagtggagagaaaaatgcacaggaggataaaagaagagcgaccctagggctgagcaagagagggactgagaagtgataagaaaaggagaaagagacaggggtagagacacagagagagcaagtagaagagaggtacatacagacacaaaaagacagagacaggccaggcacggtggctcacgcctgtaatcccagtactttgggagaccaaggcaggtggatggcttgagctcagaagttcaagaccagcctgggcaacacagtgagatccctaatcaaaaaagaaaaaaaaaaaaaatgaaagaaaagaaaaagacagagagagatggacaggaagccagggtgacacggagagggaagtagtgtccatgaccaagaaagagagaacaagaaagaaaagagaagaaacagagggcagagggggaaataaaaggccaggcagaaacagttaaaaaaagaacaaaaggagaaagcaaaggagagatgttacaaatatgggagaggaagcagggaaacaggaagaaagagagggagggggtagggagggagaaaggaagggagggagggatacaggaaggaagggaaggaggagggaaggggagggagaaaggaaggaaggaaagaaggaaagggaggggtagtgggggagtaaggggggagggagggagggagggagggaaggaaggaaggaaggaaggaaggaagagagccagggaagaaaatgaagaatggagggaggaaaggaggaataaaatgaaataaggaaagaaaagttcacaatgggaagaaaaagccagaacagagcagcacaagaaccctatcaagcctctcctggattctttccctggtgtgtcctggataaaccctgggctgcagctcaggcctctggtcagcatggaaggtttcctctttgctcccttctcataggagctgaaagtcccttcagggtcctatctaggatgtggcctgacaggcccactgagcaggttgggtcactgatgctaagagaaagcagaaatatctgaccttaagctgaatgaaattctttcacctggactagacccttgcctccccagttgccaggggctggtgtctgtcttcttgcccccatcatcttttgaaatgcacagcctcaggctgggcgcagtggctcacacatgtaatcccagcactttgggaggccaagacaggtggatcacgaggtcaggagttcgaaccagcctggccaatatggtgaaaccccatctctactaaaaatacaaaaattagctgggcacagtggcacgtgcctgtagtcccagctactcagggggctgaagcagaagaaccgcttgaacccgggaggcagaggttgcagtgagctgagattgcactactgcactccagtctgggcgacagaaggagactgtgcctcaaaaaaaaaaaaaaaaaaaaaaaaaaagggaaatgcacagcctctgaattcatgaaaagttcatttgagatggcccctttcaaaccctcttctacaaatggagaaacgaagacctccaaagtggaagccacttgccaaaggccccatagctgctaagggccagagacaggatgaccctcagcaatctcacctcctatcatctggacaagcacttttgaaagcaagccctggagggctcctgatgactttcatgctgtttccagtaaattctgtgctgatttttggcatgaagaaaggaaatgaagagggtagggtaggaatgtaaataaagggaaacattgggatttcatctaatatataattatagtatccatggtggtggccctggctgcctctgtgatgtgcttcccaggctgtgcccaggagaggtggtgtcctgagggtggtggacaggccagcaatgctccatccaaggctctcagccccctgggcttttggaataggattgttgggccaggagcctggacttgcttgctgagacacatgggagtctgacagtgctgggaaacagctcggcagatgagagctgggaaatcaagggcatcgcacaaatgacaatgggagtccatccctagggaggagcaggggtcctcatgcagaccccacatacaattgtgtgtgtagtgctgtgaggactgcggggaagggacaaagtttgaaattcaatggtagccatgtagcttttgtgtgacaactaaaagtgtgttttccatattgtttctaacccatttgggcatggatctttgtataaaagatccctgcccacagcttccactctgacccctgtcatttctatatgcccaactcttctcataattcggtgtggcaattttcagttcaggcagtggagataaactggttggaaatctgcctctacttactagctttgtggcggtagtcaagttacctaacctctctgtgccttagttgccttatctgttaggtgagaatagtagcaactaccttacagagttgttgtgaggattagattaaataaggtttataagaaagaaagaaaaagagagagagggagggaagcaaggaaggaaggatgggtgaagaaaggaaggaaggaaagaaggaaggaagaaagggaggaagtgggaaaggaaggaaggaagggaggaagggaaaggaagggaaggagggagagagggaagtggaaagaaggagggagccaagagaggaaagcagacagagaaagatagaaatagaaacatagaaacctagagacagatgtagagatacagtactggaccacagcctggcacatagtgggtgtctcctgaatatttggtgagaaagtgagtaggaaattttacatgagtgaaggggagaagtcagtgtctacagaatttccacattgacttgaaaatttgttcaaataattcgacaaagatttattggattcttaattagtgtcagttactgttctaggtaccagggatagaggatgaacaaggcaggcacagaccttggtccaatgtccttctagtgagaaaagatagacaaaaacaagtaacagagactaaatcattacagtattagtgagtaccatggctttgtgtgtctgtgtgcatgacaggcaggtagataaaagtggcaaaggaagatgtctctaaagaggcaacatctaatcatggacctgaaggagaacaaggaaacacacatgggaagagtcaagggaaggacatcccagggaaagagaacagtagaggcaaagaccttgaggaaggaagagactggcgcactctagcaagcgtgcctgcagagtggtgggtaggggcaagtgtgggagaagaacgccaacctgctggaaggctgtgaacatatggtgtcagcagaggccatcccacgtgtcactgcttaggtaatgtctgtcatcacaaatagtagtcacagtggttactcctcctcctgctgccatttggtaagcactgacaatgagctagacattatcttgtcctctttacatattttagttcattgtatcctcataaccctatgaaatagatcctattatgattcagttttatagataaaaaactgaagcagtctgggcatggttgcacatgcctgtaatctcagcactttgggaggctgaggcaggtaaatggcttgagctcgagaccagcctgggcaacatggcaaaatcccgtctctacaaaagatacaaaaattagctggacatgatggcacatgcctgtagtaccagttactcaggaggctgaggtgggaggatggcttgagcctgggagattgaggctgcagtgagctgtgattgcaccactgccctccagaacctcagtgacagagccagactctgtctcaaaaaaatcaaaatgaaacaaaaaatctgaaacagagaggtgaagaaacttgcccaaggccacacagtgggtaaaaacccacctctgtctgatttcataggcctaatttaaaattatgtgcatgtgctagtagtggtaggggatgcagattcacaaagtctattgcctttcctgttgctgctttttgaaaaacatagagtggcactgataacccttcacacgtgtacacaatcttatgaaaatgttgaagtgaatttctgtctactatccaatttaatttgggggaggtatgacaaattatctccattttatggataagactgattatctccattttaggaatgagaaggatgaggtgtgaagtacccccacctcccatctataggctgtgatctgagtcttcggcccccaagcctagtattctttccattgcaaacagtgtcatttgcagttaggaagttctcttccactcatacctcaccaggtgctttgaacagcacatgggaggaggggaggagaggagcaggtgggcattaagaatcagcttgggtatgaatctgagctctactccttctcattatgtgacattggggaaaatgatcactcccttaagctctagctttcccacctgtgaaatgggagaggccaaaaataacactacccggccgggcacagtggctcacgcctgtaatcccagcactttgggaggccgaggcaggcggatcacaaggtcaagagatcgagaccatcctggctaacacggtgaaaccctgtctctactgaaaacacaaaatattagccgggcgtggtggcaggcgcctgtagtcccagctactcaggaggctgaggcaggagaatggcgtgaacccgggaggtggagcttgcagtgagccaagattgcgcccctgcactccagcctgggtgacagagcaagactccgtctcaaaacaaaacaaaacaaaacaaaaaaacactaccctatctctaggtttatcatgagaattgaatgagatagtacacataccttagaatggttcctggcacatagtgaatactcaataaaatattattactagcagtattatccagaaagtcctggtggcactgggcatcagaacctctgtttggagtctccattcctgcctcagtgtgcaagcctccgggctcactgaacttaacctttccatgtcacaaataatactaagaccagaggagggggaagaactgacccaacgtaccactgagagcaaatgtgaaacttgctgtcggactcccaacctcgggctttttttcacaatgccctcccttctccggggctttgctttttcttctactcttccaactctacccaccccgctaagatagagcctctggcctaagcctctgttcccaccatggatgttggcacttggctacagtccccaggctcccttggcattcctttcatagagctgaagccagggaggtgagggcgggtctggggcaagcctctgaatgtgtgggaatgcatcccccaccccaggaatcaggcctggctgctgctggcatgcttgctgaggaccctttggcagccttccacaattagagaaaggcaaggcagccaagacaagacagaggctaattaccttgggtaataggaaattggagagcagctacaagaagggtgtctgggcctttggccaggcaagggcagggaccatggatgcccagccaggcctgagccattggccctgagtggagactcctgctcagggtcacccctcgattccaacaacccacccacggcagcaggagctggccctgctgtcagaccttcctgggacccactccctctgctgcttttgtttgttttcattcaaaagcaaaacaaatgaaataaacaaggaaattcaatttaaacagggcacgggtgctgatgtttctgttttgttacaccagggtgagcttaggacagaaaatcagccttgactttcactccttcatttggtcttaccctgtggcactgtgtaaatttacatggatggaggggctacagaaaaaatttgccttcctaggtggtgtggaaagagggagttggggttggagtggggtcagagagagggagagaggccaaaattcaagtaaaaaataggaccaagaaactgagatacactcatagcaacagaaattaaaataatgaataaaaagacaaaacaggaatggtagggagaatgacagacagacaaagacaggaagtcatatagaaaatacttacacagagagggaataaaagacaaagagaaaaaggcagagacgcagagaggcacagtagtgcaaaacagatgtgagagaggtagaaaagctggaagggcaggagctcaggaggagagaggggatgaaaataaatcccatgacagaactcatgagctaggatctcatgcaccttgattttaaagatgctgacactgcagaacagggaaggaatctgaacatttaatccaaggtcccagaggcagaagtagtagcagggcatgagcccagattccccagtggagagactagtccttcactctcctgccacctgaatcctttaaaagcatgggtgcagaatttggtgtctgactgtgtttaactaaaacttggtcccttctgagacctctctcctctacatcaatcctctcctctcattccatttctctcaaaaggattctggatggtcgttccttccaaagatagtgggaccccaacttgcctgataaggaccagttcctccagagctgtgcttagaaaagacactgataaccagcgactgagaagagtcaggggagaagaagaaagtggctaacacgtcctgcaggctgcctatatgccaataattcaggtaagccttgtttgtggagttttcaaagtcaactctcttccctacaaccctttgagatagggacaatcaccagcctccttttccagaggtagaaattgtctcatagagcagtgaaaaacctgcctcggggcaggttatgagcatgaggcagtatcagggttcacacccagccctgcgtgtccccaaggcctgtgctatttctactgccgcacacagtcttcttggctcaagaggaagacgaatttgggtaaaaaatgagcaagcaaaaaatgagaatccccaagaactgacactggaactattttaaaactccagaccgagctggtcagactccatgggaggagagccgccaatgggataagagactgttccaaacaacaccctggttcctggtcagagcggcccggatcccagggccattaacatcatccatttcaaaaatacataaataaaatagagaagtgttccgagttagagatgacaagctcctgacaagcacatttccaggacagaggaagaaagaatgttccatattttaagaggtggaaaggaggggtggtgtcaggcagtgaggaaaagaaggggcaaaggaaagtgttcatcacttttaaagaatgtcagctgatttgtcagctctcagtgttaattgctttcaggattccataaaacatttcattgctgtctacataatggggctgcaggattccagtccagctgacatcaagcccctacagcgtcacccagagacagggttactccttctgtattagtgaataggaatcacccgacaggattctgtcgttccctgttagatgctgtatctcctatcatttggtggatggatgggagaaagttgaaattatcacaagggcaacaacagcaacattgataatagctaacacttcttaggcttctactggaacctcatcactagagagcttttgtccatgatcccttcaagtcctcctggggtccctgtgagccaaacaccacattatccacattttcaaagagaaggaattggaggctcagagggatgggcagctcactcagcatcacagagctgataaaggacagggtcaggatttgaatccaggtctgtgtgccttcagtctataaccctaaggaggggagaaaccagaagccatctatcagaaaatcttttgaaaatgccattcactttcttcacagaattatagttttcagagttagagaggacttaatcgctcttaatgtagtcacatacttgtgtttcacctcacacatgcagttgtcccagagcccaaggtgttggtgagtgcttactgcttaagagtgtgtagagttgtgctctcaaagtcagtccccagtcccaccactcaccatgaggatggtggtcattctttaaggcctaaggtacatcttaaaaccttagtaaaatttgcccagatgtcccactggaagacgtggaattgcatatttactttgaagattccattcctagagcattcactgccccccaggtgacttaatataaagcttgggtcccaacatctaagagatagtcagttgcagagccaggggcagaagactcaattgccagcttttggtgatattcttgagtttggtgacccaacacattggttgttaccaaggagtgtgaatatctcaagtgttcaaaagggtgaggaagaggcagggagaggaaggggaaaatgggttgtgctttgaggtaagcaaggttcacagattgtggaaggactaacacttactgagcacatgcttggagataccaagccagggtgtttcttgtttaattatcacacaactctacaaggtgggttttattatttgttttacaaaggctttataagagacctataggggtaaagcaacttacctaaagtcacataactaaaaatgtcaaagccagatttgaatccatagtctgtggcctttcttacaattattaggttatgttatctgaggataggacttctgtcttagtctcattcatatccacagtgcttagcgcagaaccaaaacacaagaaatactcagcaaatgtctagtgaataagtaaataagttatgaattagtaaatgaatatgtgaatgaagtaattgatgaatgaataaattaatgtaatgaaggaatgtaagagcaggtgaatagatggatgaagagacgaatggatggagggaaagagggaagaagggcaagagggagggataaatggaaaatagatgaatgtttgggtagacagatagttaaatggatgagtgaatgaatccctgagtgtctaaatacagtaataaataaatgagttgaataactggtgaataaagctcaacttcgtaacaacttcagctttctaacttgacaagggaggtgagctatcattccataattggggtacataaggagaggtggtctataaagctctatgttatagcttatgatggttgcatctagatctaaaaacaacactcattgaggtaggaaataaaaagtaacaaatgagctccttttctcttccaggctaacaaatgaagctcagagtgactgcctcttgcatctccagaagtttgaatgcagtgactccaatgaactctacaaaggagtgataattgcactatttttaaaaggctggctggatctattaataaaaaagtgtatattgtatatatatatcagcatatatatctcagtatgcgtatttcagtctgtatgtgtctatatatcagatatactaatataatatttaaagagaagaaaggatacaagaggtaaaagatcactaggcagagatccctgacccaaccatccttgataacttcatctgtgctcttgagtaagccctcttctctctctgagctacagatttctaatcagtagaaggaatggttttaaatttctggcctctctgggcacttcaggactcacctggtgtgattctgtgatccattgtggcatacttctcaaatggacacttctaaaccttagaatctcaagttgcacatacaggctagctaataaaacatttggctggcctgcacagaataactcatgccattcctcttaggcttaaaatcatcctgtctgcctcatgatccccacacacccaacacatcttacttgtagagaccgtcgggctccagacacttgaagatgactgagtagatactgacttcagggacctctccatggcttcgaccagctgctacacaagatgtgcccaggccagagagtaagtcatcagcaaaactcaggaattctcctggagggagaaaaagaaagatgagctccccagctcaggccatagtgaggagacgtttttgctgtcatccaaacctatcaaatgtcttgataccattatcaagaaaaataatggatagaaaaagcaaaagatatgaaaatgaaacagatttgtatttagccttgatgactctttgttcatatttatgcgcaattttttcatccataaagtggaaacactaatacctacctttataagattgtagcaagactcaaatgaggtaaattattgtgtaataaaaatttatgaaaaggtagcaaggatattatgcttttttttttctgtaactattctggccttgtcactgttattcactccctgttaactccttgagcaaagctcttctctcttagaattgcattttccttctttgtataatgaaggaactggactaaagatgtaaaataattttcatgtcaaattgccactgttaggcatgggtactggattcatggagtgttatagtgagatggacagagaccagctaaggagtaaagagttctgtgattgattagtgatgaaggtcatggaaccttcaccatgtacaggatgtacatgatgtcatggaacgttcaccatgtacaggatggaacaatgggagactatgtgccacatatttgtgatcctcaaactccatcacttctttaatttactttaaatctaaccattggattttaagaagtagtggaagtttactagaaacagaactaataaagaagtctaggaagtaaagaaaactagaaagaataactgaacatctagactcttgggatctagtcttagttctgttgagaatttgctgtatagtcttgggcaactaaatcctcattttttgtgcttcagttttctcctctgcatggtgaaggtgccagaatcattgttaggattcttgaaaaaaataaaataaaaatacagatatgaacaaaaattaagttataaggataaacatcgcagtactatttatactagcaagaatgtagaaacagctaaatgtccaactacatagaaatggctatatcaattgagttcaatgatgcaataggctattttatagtcattaaaaataatctgtgaaagaatatgaaaggatatttatgacataatgtgaagttaaaaacaggttacactattacaaaataatctcatttttgtagaaattttatatgcacatgcatttaaaaacagaaggaagaaaataaaaacaaatgtttaaggtggactgtctggagagtgacataatgggcactttttctatcttatttttgcttatctctattttaaaaattatcttcaataaacatatattgcttttgtaacccataaaaatatcaataaaaattacttaaaaatagataaagtaaatgggccagactaaatggcctctaagttcccctctaattctaaaattggatgatctaggaaaaaaactgacatatgaggtatttttataccgcacagtataaaatgatatgaggcctctcaactgttgttttcttcttttcttcatgcctgatagagagttcctcagagctctattcatgtacagccccactaataaaccagaaaagggtgccagctccattacatcctctctacctggggttaagaacaagacaatgtcatgaaaccataaaagaacaatagtgttggctcgtgtttcagaagattaggactcagagcagcttggtggtgcttctctaccaaggaactggttgagcagaatatacagatcacttcctgttggtctttcaaagaaaagtttcattctttattttatttatttatttattttttaattttaattttaatttttttgagacagggtctcattctgttgccaagtctggagtgcagtggtgcaacctcagctcattgaagcctctgccccgcaggctcaagaggtcctcccacctcagcttcccaaatagctggtactacaggcatgcaccaccacacccagctgacttttgtattctttgtagagatggggtcttaccctgttgctcaggctggtctcaaactactgagccttggcctcccaaagtgctgagattataggcatgagtcactgtgcctggcccaaaagtttcattcttaaagaaaaacagttttaaaaagaagagtttcattcttcgtctcacaagtgaatcttgcaagacttatctgactgaattggccagatggccctgggattcagccgaacaacagttctagaaggtatttgctcctttagtccaatagagcaggtcttgatgggtactgtttcttggtttctatttttcacgaagacaatacatggttcatagacttgacgcgtagatgctagatttaggatcaagtgtctaaatcagggtagtgttggcaacaggcaatttcagctgccactgcaagacagacctgagactgagtactaattccaccatgggctgcaagtccttaaacttctcaatgtctccatttttctttttgttacaaggagttaacagcactctcatgcatttggagtctacagagtaaagccaagggtctagaaagaaacaaagatgcctagaaccagaggtttgtctggaaaatgaagatgtgaatgaatcttttattcagcataattttggcatcccacatttcttctgtaggcctcttatatcagtttctttcatagtacaaccagaaactaacaatatgtccatttcaaaaaatatcacaaattccagagcaatgtatgtgataaaaagtaaaaaaaaaaaaaaaaaaaaaaaaaaaaaaagggggcattggtggtgagggtgagggtaggggagagaaaagacatgagattattcactagatggagtgagggtcttatttcacttgggtactcaggattccaagtctggctacatgtgtttgttttctttgagcttgggtccatgtctgtctgcttttcaatttgtttccagatagccaatgagagagctggatcttcatgagtgtattagtcattatcacattgctatgaagaaatacttgagactgggtaactcataaagaaaagggatttaattgactcatggttctgcatggctagaggggcctcaggaaacttacaatcatggcggaaggcacctcttcacagggtggcaggagagagaatgagtgcccagggaagggggaaatagccccttataaaatcatcagatctcatgagagctcacttactatcacgagaacagcatggggtaaccacccccataatctaatcaactccctcgaggtccctcccaggacacatggggattatgggaactacaattcaagatgagatttgggtgagggtacagccaaaccatatcaatgaaggaactcagtatgtttgtggcctgtgttaattacctgtcttgagatgaaaagatggctgatattcattttcaaatgggaatagctttccagatagttccatgaatttcagaataattgggaccatggatacaagccccataaacatgtcaggtcagtaagactggcatgattctatgttctgaaaaattctaaggtttgcaggtttaattcaagtgaaggaactggctcacctgcagtatatgcagtataactagtcataccaagatcattataaggatatttagtgcccagttctattcacaactgtatgaatataatcatcttcaaatgagaaagttaaaaggaaggcaactgacatctagtacttatttttcttttttccatttaatcctcacagcaatctaacaagttagattttatcttccccatggtaaagctgaggttaatgttgcagttaaaaaggaagatagctgagattagaacccctattttttcagttccaaagacataccttttcttttatactatgctgcctcctagagaaagtttgaaaatgatagtattagaaagggaggtttctcaatgctattcaatttgcaattgaattcccgccacactcttagcttgaggaatgagacaataaaagaaatggtccctgaccttctacagcttgtaatctgacaacaggaagggttgttaaatacaagaacaaacctataaagtaaactgtaagatagctttttttggcactggatttcagaaggtttaaatgcaatttagatgaagacaggtgaatgaagtaatcccccagtgttcttcctcacccagtggagggggtactaagaaaggcatgggggcttctctatgcacaaatgaaaatcaatgcaattcaacacatgtattttagttccacaatataacatactctgcatctggcaaccatacaattgaatgagcaataatatacagagcagtggttaggagcctgggcttttaagtttactctgcctaagattaaatcctagtactccacttactgcttgtcttggacaagctccttaactctgtacatctatattcttatatgtaaaatgaggagaataatagtatctaacttagacagttgcaaacatcatataaaatactgtatactggaacacagtaagagcttaaaatgtgtatcaactactactgtttttgtttttctctcttttttttttttttgagaaaaagtctttctctattgcccaggctggagtgcagtggcatgatctcagctcactgcaacttccacctcccgggttcaagcaactctcctgcctcagcctcccgagtagctgggattataggtgcccaccaccatgcctggctaatttttgtatttttagtagagacagggtttcaccatgttggccattctggtcttgaactcctgacctcaggtgatctgcctgcttcagcctcccaaagtgctgggattacaggcatgagccactgtgagagccttgtttttcttattcttgttttcaacataacagagtagagataaggactcttaaagatatcttttcatccaagcttctctttttacaggtgacaaaactgaagatcagagaaggacagtgacaggtccatgcccatacactcaacaggaggagatttggaacaaaaacttggtgccttgactcctggagtctcggagataacttgtaccagccaacttatgagataaaatcactgagaatttaaaatctctcaaagctaacacaggagcccttcctccccaatttctgaccactttattcaacatgaatgtgatatacagtccctgggcaattactacgcaccagacactgtgctaggtacatggttccaccttgccatcttcttaagcctggaatttctgagaaagacacaaagtctccaagagataggagtttagtacatttctaatatgtcatatattttaacagtggtttgcagattataacatagagaactccaggggcaaggatgaacactaacaggagagagattggggccagtcttccatatactcacactaaccttcaactagatcaactctagtttgatctattttatatactagcggtccatgtttttatttagttttttacaaaactgtttataaaagttggttttaaagttttattgcttaaagtgtttgaattccagaactgtgctgtattctctgatagaaatacagaggcttgggaatgctacaccttaattcaaggatttgcagctactcaggggcagaatccagaatcaagccccactgtcttgcatctgagccccatgcacctttcactaggccactctacctgggaggcctctgctccgtcctccctggtaccttgttaggggcttatggtagaaccctcctagaacccaggctgctgcttctgcctcgcccaagttcgtccaagtctctaacattcttttcctgtttttctttccttgaaaacagatagggagttgggagtcgctgtacaggaatgtgcctgttccccattacagctcttctggggctgtaacccgagtgggctggggccagacccccacacatttctttatccactcagactctagccttgctctcattaccttccacagaaaatgttaatcatgattctgctgcagcttcagaatcaacccaacaaagcatggatcaatttttctagaggccccaccccctattcctcaattccctctccctctcctttcagcagtccctcaatcctcctccttgtttcccctctctctctctttctcccctcaccctcttgcttctgaatgagttgaggtcaccgtcaaagccggccacatgagcaaattgaaaacaggttgggagaaaagcagaaaagaaattccagaatggaaggagcagtgggagtggggggatgtgggggtggggacggcaagttttttagcccaggtgaggagaaaggtccccagctcagggctccacactcttttcgggaaacaccaagaggatttaggagtcgtcactctgggcctggcctctctaacctgcagatgctctttgtcatggtgcccagggagaagcagagctctctctgcatttcctttacttgggcaactgtagaaattcattatgagaacttgtcagggacaaaatgcatctttaagggcctcatacctatcagctgcagttggtttgtttcttctgaaacatggtgttattttaaatctgaagaagcagtgtgtagagatcctcacctttattgtaatggcagtaggaggtagtagaaagagagtgggttttggggagcagatgacacctagttttgaagccagacctaccacttatgaactatattatgtagagatggatgattaaactctcagagactgcttcttcatctgaaaagatgatcctatcaatttcagagagtcaggtgaggattgagtaagagaatatttataatatgtctgatacatgaatagcttacaaatgttagtgcccccctcacccctgctccctcaggtctgaataatttgtctgatggcaaaatttttagttatcacgctcagttgcttttaggtgcattacatcatatctaactccctaaaaccttcctgtttttttgcaaaaagaagacattttgaatggaaggaaggaatgaaataagaaacaaagaaagaaaggaagcaaaaagagggaaataaaaatgttatttggcttttattacatggcatcaacaacgctagacatttttacttatattgtcttggttaaatattcaaaacaatccatcttgcttaaaattcgataaaacctaatgaattcagtgaattgtgcttttgcagatgaggaaacagtttcatctgtaaataactttctcacaaaaatctacctaggaatgtcagagtaaaggctgaagtcaggacattcagcacccaaagtctgtgcctttcctactgcacatttccctccagactgcgagatgcctggggtgggaattctgtttcagtcacccttgtgttactggtgtccagcatagggctgatgatgaagctatttactgaagcctgtgaaactgaacttcagtggttgaagcctggatctgctcctatttactcgacatcagcacctggcattagaactctctcttgggatagccaggctgcctcctgcataacctttcaggagtaaataggacacaaataatacaggaaaggaggaaatgacgtaaagataagggctccaaaaaaagggaatagtgatctagcaaatacctactgagagtttctgtgtgccaggcatcgtgctgagacttcaggctcatcctcatgcctgccctctagtggacacctgttggtttgactggctataaaggcatgcctctttctaccaacagcacctgagttttcctttggggaaccagctctcccccaatctcagtctaaacaatttaggtagagctaaggccccttttatccttcagagactggcatgtgatcgatggccagccatttcatgtcaaaggtcaaaaagacaagtgacctaggcttaatcaatcagactaactccaggtacagacaccaaccaagttctgatgacattatttgaagccctggacccagttgtgtctgaggcctagatctacccttgggtatttcagatacatgagttagtatttttgcatttttgcaactttccatttgttttctgttccttgcaatcaggagtcctctcaaatacaaatcctatgaggtatgttttatgattgccattttataaatgaaaaaataatgctcacagatctaaatcaagtagtccaaagtcatactccatctaaataagaaggctggaattcagattcaaagctgtcagactccaaaacccgagcctttcctatcataaaacgctgcctagggtgagggatacaaagactactaattaacaagaattcacggggtatctccagtgtcctgcttcctcgggccccttcttcctcacttcctgggctcctttcctcactcacgcattccagccatgcagacattcttcctcctcctctaacatgccaaacatactcccaccacagggcttttgcacctgtggtttccatggagccttcttccccttgtcgttgtatggcttactccctctcctttcccaaatccttgctcaaatgtcacttgctcagaaaggccttctctggccactcagtctacaggagcatccactatcaccctttaccctcttaacccatttatctttacaaaatttatcactgtctctcatatattgatggattgatatattgcctgtatcccctgctgtaaaccctgtgagtaagagaatttgttcacttagaatggtgtctgtacacagtaggttttccataaatatttatatagtgagtgaatgtatctgttgtgtgcttcaaactgagctgatggctgggagcacaagcataaagaacactttcgtttgaattccctggaaagcagagcttaagaacaatggcttgggtgcagaaggtttatttgggaggtgattccagggagcaggtatggggtaaagggcagagtaagacagggaagagaaaaagtcaatataaaggtatatcttcaagtttgctactgtacatgatgggacctaattctgcaagacccttttaaggagggaacaagataccccccagaactgtttggctggaagtcggggagatggggcacttatctaccaattcctgattcccattggttgggtcctgttttagtctattctcatgctgcaattaaagacatatctgagactgggtaatttataagaaaaagaggtttaatgaactcacagttccacatggctggggaggcctcaacatcatggtggaaagcaaaggaggagcaaaggcacgtcttacgtggtggcaggcaagagagcttgtgcaggggaactgtcctttataaaaccatcagatctcctgagaattattcactatcatgagaacagcacaggtaaaacctgcccccatgattcaattacctcccaccagggtccctcccataacacatggggattatgggaactataattcaagatgagacttggttggggacacagccaaaccatgtcaagtccttcacccaggagtgttatttccccacacttttttaaagttgtacttgcacactggcctagggagctccttcaatctctcataaggctgtggggcagaaagtgcaagtgtgcatctgaggtcactggcagcacaaagtgagcctgagtgtgcacagagctgctcaccacagctgcagctgaaatagccatgggccaagaggatatggcatggccccagaggcatctgctataaagatacagtctctgcctttaaggagtttgtaaaaagagcaactgacttgtcttccttcttgaggtctaggacaaacttgttagcctcactgttcaaagagttcacaagcagttatcgaacaccctctaggcgccagggaaaggactacaactgtggtcacagctctgacccacaggaacaaaacctcttccctgtgatgctcacagttttgcaagggagaacggcaaggactgcttttacgtgcagccaaccaaggagtcctgcaacttatgattaatactgaatttaatagtattaacctcaacattaatatgcacttggcttataaagccttcctttttctactgctggattaattagagccataaaagccctcgtcatccccactgtctggaggacaaatgatgctaatgcatttggctgcagcgggtattgctaacatgtgtggggaaagctgatttggggaccaggctggggagaagggggagggatgaaggaaggccaagttctcctcccccccaatcactctttaaggaccacagtgtgagttcactgcctttgaagcactcatccatggagggttttcttttacttttttcctttttaaaattccattcccaaatgttatatcattgtaaagtggaaagaaccaactgtacgatgtgcttcctatcagattctcagttcccctaatacttccaactttctctgggccaaacacttcattcaacatctccctctctgtacaaaaaggcaaaaaccacgaggttgctgacggtgggccctaggagcccctctgtccacaaatgtgatgaaaaagcatagtatctggcagggttgaagttatgattcttattttgtgaagaagaaaaaagaggctcagagagttaaggcaagccttccaaacacacagctactacccagcaaagctagaacttgaacccaggttgatccaattccaaagcctgttgtttttccaccacaacaggcacttcttaattgctctgtctctgtgaacttcagtctccttgtctctaaaataaggatatcagggccaggcacagtgagtgtcccatgcctgtaatcccagttcttggggaagctaaggcaggaggatcacttgaggccaggaggtcaagatcagcttggacagcatagcaagaccccatctctaaaaaaaaacaaaaaacaaaaaacaaaaaacagccaggtgtggtggcatgtgtctgtagccctagctatatgagaggctgaagtggaaggatcacttaagcccaggagatcaaggttgcagtgagctgtgactgtgccactgcactccagcctgggcaatagagtgagaccctacctcaaaaaaaaaaaaggaggatgtcagtatctactctacaagaaagtgaagaagagtacattaaatccattaaaggatttataatctgcaaaacatgatgtatatgtcagtagatgttgctaaggaaaattcacacagtgccaggtaaggtaataaaaatgccaggtcagtacttctgatacatatgccaatgttcagctccaaggacatagcagggcacaaaaaatgtgatagtgaaggatctttaataacctggaaacatagccatcttaaacaaagcagaatttgaatgccaatacactaactcacttcacacacgaagaaaaaagttggggtatgaggatgctatgctgcaggaaaatgtattcctgagattagagcttccataactcttccctagttctctaaagagctggctgcttctgttccatcatctcagctgaagttccatccctttagaatcctctgcaccaccccgactaatgcaaatccaaactgcccactctcagttatgccccaccagagaactcttgattttattccaagcactagtgataatttgtagttactgtgtttgtcactttatttacctctttatttgctttttattactaaaatattaattcatgagtttagaagccttgtccatgttgttcatgatttccccagtgtctagcagagtgtggggggcacagtagctattcattaaaggtcgattgaatgaatcaaggcagggatgatgccggagaggtactcatgactcagtcaaggttttgtaaacacgtgtggacaactaatgttcatcccttaagtttttgctcatacccaatgtctttcaaaaagctcttcttggtcactctttgccttcacctggcaaagtttagggcccctcaactgagttcccacagctccctgtgtccctctctattatagtccataactcattgtcctgtaattacatatgtagttgtcttcctcccctcatgcactgggaggattatggtaaggtacctggcctgtcttagtcaccacctgagccctagtgcctaggcttatgcagaacaagtgagtcaatgaataagcatggcttcctttacctgctggaagaaagcccatggggtggaagattggggggatgctaggacctcattatgcatcaaccttggagttgtgttggaaacagcaatcccatgaggccactgggtcttatgtaaaagagtactgagtagagattcaggggactggtcagtgcccctaccttcttatgagattctgtacgaataagttcatctcctcatccaccaaagcacaggaccataataaaaagaatgctcatcaagttctccaccagcctttacctgattcagtcttgcaacccacctaactcctgtttattttcctctatatttctctatcactttatctatctgccagacaccacaccccaggaaatctccctaattgatatgattgcttattgatgcctgacgaaccctggagtttctgcccagcctcaccctttgctacagcacctcagccacccacactggttacccattaaccctttgactctactatccctgtgcagtgaggattgctcttctctttccactgccctctccttttgtaaaaccctttttagtttacaatgtatgcctccaccacctcattaaatttaagcttcacaagtgcatgatgaggtgggcacagcacaatggaagtgaaaatttccatttaggggaaggtgaatctccggaaaggaatgtgggtagctgaagaggtactggaaccagatcacacatttctaacccctgatcccgtgctgctgtagctatagcttgtgctcttgtcttctcatccaggctgtgagctgagccatgactaatacaggcttacagccaccccctgcagtggctaacaaggaacccacccttactgtgtccctccaaacatgttaggcaattcaattcactaacatgctgatatcaaatctcctttgagagggaaaagcagcagaacagacaatattgtgctcagccctgggtttgaattctggctttgctaaatgattctaagcaagtgacgtcatctttttaagcctcattttccacatctgtaaaatgaatgtgaaaatatctatctctagggaatcaatgaactcaaataagaattaatttagatagtgtatgggaagcacctagcacattgccttgcgtatggtaaataataaacagcagctttgctattatcactgttattttaaaaaataccaattcatgaaacactttgtgtggtgtaagcagaaaggaaaaactcaacaaactagggaaagtgaattatcctcatgtatttagcactttttgatcctcccaaaccagaactgcacaaactatgtgtcccaagattaaaaacagctgaatgcccaaacttccctcccttttctaaatatacacctcaaagcctgccattaactaatagctgggatatcttcagtagataagggagactatttgtctttcttcttctcccctagggtgggagaagaacccaagctccaaacccaagtctgaccaggactccccaaaggcaatctctgggaacccaaaagcaccagtggggtgtttggttttttgttcttgcgatagtttactgagaatgatgatttccaatttcatccatgtccctacaaaggacatgaactcatccttttttatgcctgcatagtattccatggtgtatatgtgccacattttcttaatccagtctatcattgttggacatttgggttggttccaagtctttgctatggtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccagaatggttgaactagtttacagtcccaccaacagtgtaaaagtgttcctatttctccacatcctctccagcacctgttgtcataggtgggaattgaacaatgagaacacatggacacaggaaggggaacatcacactctggggactgttgtggggtgggggcaggggggagggatagcactgggagatatacctaatgctagatgatgagttagtgggtgcagcgcaccagcacgtcacatgtatccatatgtaactaacctgcacattgtgcacgcgtaccctaaaacttaaagtataataataaaaaaaaaaaacagcaccagtgggattgaatgaggtcctgagcccatcccattccccaaactcagttctcctccatactcgcacttgcacacacacacaaaaagcatatccccctccccactccatccctggaggcaacaagcctccagaagggtggggagaaggcccaagcaaagatgagtcaggttttctggtcatgcaagcaacaccatttaaccaggctgaggtgaatcattgagaaggaggtgggacctgggaggtggcagagagaggtagatttccaaatgtgtgtgtgtgtgtgtatgtgtatgcatgcatgtatgtgagagagagagacagagagacagggacagagaggcagagagacatagagacacacagagagagacagagagagacacacacaaaaaacaaacacagagaggagacacacaacacacagacacaaagacacacactcacacacagagagaggagagagagagagaaatagagaaagagaccaagagagaactacagccagaaaatactcagaaagactgaagcagaaactgagagccacagtgagagacagaggagaaatggagagagaaagagagagacatagataagaacacatagggccaaagacagagaaccagaaataaaaatgcagaaaaaagacaatcagagagaagtggatagaaggtcagagacctagaaagacagatagaaatagagagacatagacaggagttggtgaggagagagagagagaaacagagaaaatcggggtcagaaagaccaagaccaaggcaaacaagaaaaacagaaggaagaaaggaaagaaggaaggaaggaaggaaggaaggaaggaaggaaggaaggaaggaaggaatgaatgaatgaatgagggaaggaaggagagaaggaaggaaggaagatggaaggaaagaaaaaaggaaggaggtagaaaagaagaagagaatgaaggagggagggagagagggaaggaaggaagatgaaaggaaagaaaaaagagaggaaggaaagaagaagggaaggaaggaggaaaggagggagggagggaagaaagatggaaggaaagaaaaaaaggaaggaggaagaaaagaagggaaggaaggagagagggagggagagagggaaggaaggaagatgaaaggaaagaaaaaaggaggaaggaaagaagaagggaaggaagaaaggaaggaaggaaggagggaggaagggaaggaagatggaagaaaagaaaaaaggaaggagaaaggaaagaagggaaggaagtaaggaaagaagaaaggagaaaggaaggaagaaggaagaaggagggaggaaggaaggaaggaagggcacggcaggaccagctagaagggcatcttctggagatggatgcccttgagtgaccagggaagctttacttctggtctcaccgctactcggggcagatgatctgggaggaggagggggggagagtgagagggtgactggcatttccattcagctcccctcatctatccctcccacccacatatagaggttttcactctattaaaatgactcccttgcttcctcatttatgttaaaattttccttgaaataaagaaaaggaaacaaggtcacccttcaatccacaatgaaaactataaaagcgtttttaggcttggaaaatttagctggtcagtttttcctactgtttaataactgccttgggttacactgaatgagtaaacatgttttacaagcttctaattcatacctaaccctatgagttcacagctttacataatatatacacacacatatactatatatacacacatgcacacatacatactgcaatgtaaaatataaacacacatacatacttaatatatatatgagtgtgttcgtgtggtgtaagtaatctttccaatttgtgcagctcattagggcttacaaagcacgctctttcctcatttaatcctcacgataatcctgtgaggtaggcagtttaggattatcatccccagtttacaggtacctgtggttaaggtagagagaccaagaacccacaggtctctaaggcatcacagtccatatcacagttctgctctccatagtcccaaagctgacttcatgaacttgggtagtgcagtgcccacttctggacctgcaaggacccaaaaccatggggatcctgaggcatcatctgtttcagggcttcattgtacagacaggaaaactaaagctcagactattactgctagcctatagggtgcctctgtgcaaattggaaaaacaatagaaaaataaaaatcatctctttcttaagatacttccctcccttgttccaatattctgatttgttagaacaagacacttgatcaatgattaatacatgtttatgatgtctacaattggaatggtgagctttggaatgtggtagcattgtgagcagcaaaacctgtgcgactgcatctgacatcgccaggatgggggcccaaccaaggtgagggcaaagaggacggtaagggagaaagaaagaaagaagggaaggtaagatgggagagacagcacctactttctgaggtctaagaagaaaacccattttacttaaaggacattgagataataataataactagtgtttattaagctcttaatcttttctgatacttacagtaaccctgtgagagtgtttcatattgctaactactgcttgtatttctatcttacactctcaagtaataataatattattcagaataacagtgacaattgatataacttaagcattcacaatgttagatactatgcctagtatttcatgtactgcatctcatttcagcttaataacaatatgccagcctgggcgacatagtaagacctcatctctacaaaagtacaaaaattaactgggtgttgtatcgtgcatctgtagctccagctactcaggaagctgaggtgggaggatcacttgagcctgggaagtcaaggctgcagtgagccaagatagtaccactgccctctagcctggatgaccaagtgaaatcctgtctcaaaaaaaaaaaaaaaaaaacccaaaacaacaacaacaaaaaacacaagttagcttatttccccaaatttacaaatgagtatatcaagattcagagagatccactaacttgcctaaggtcacttggttaaattgcgcaactgagatttgactattatgagggaagagtaaaggtcagacacactttcacatcctctaaaagtgactgaaatgctttacattctcaataattactaactatgctagcacatcagagaaccctactttgcatatggggcatcaatatctctgacttctcatctcgtgtgcttttagtatctgatagtctactcattcctttaatcgctttgaggctactgatgaatggaaccatctagatcatgaatccagggagtctctgctctgtggaaacaatgttggttcccgctcagcttttccctggtgcccagctcgcctccctgtttccacctctcccttactggatacccaatcaatgcaaatggatctgagtagtcattagaatttattttttaagaaaagcaaggcaaaaccaaaccaaaaccagaagtctgccacaatatgcaaagaaccacctttggattccaataaaactgggcttcctacctttagcatcctcttgtgtaagacaggaataagaagtattaccattttaatagaatgtttcaaggattcaatgtgtaaaatatctgacccagtgcttctccttaatgtataaaatgtattccaaaacaagaagtggcgatgggtcgggggcactcatgttgcactagaactttacagtgtacctggtattttcatatccatcaactcctaggcaatccaaagcctcactactgctccagctagagcgccttccctctccctttgctgactacacttcaatgactgtgccctccttggtgctcctgaggatgctccaggggctttgctattgctacatcctcagtctggagcagtctacattcagctagccacatggttcacttcctcccactttccggtctctgctcaaacatcacaccctcaaagaggtttgtcctgatcactgtaactaaatggtatgcccccaacctctatcctcataccctatttttctttcaaacacatagtacactttgactctgtattgcacatctattactttaccatcattgcctcccaaccctctgtaccgggaacataagctccatgataggagcttgttcagtgccttctcctcagcttctggaatagtgttcggtatgtagtaggtgttcaataagtggttactgaatgacttaactcatagttgttcatgaaactctgagaggctggcaaggctggcattctgatgcacactttacatgtgaataaactgaggcccaaggaggtgaagaaaattttctaaagtccttcagctggtggataacaggagtgggactagcaaactgagctgccagactcaaatccaaagctctttgtatttcaccaacttgtatttcctattattgctccccttcacctccaagcatgccctgggaaatgggtgttatttgggattttacctcttaggcgggaagccccagagatggaggagtaagaaggagtgacttcacatgttctccacccagacataggccttgctagagtcccatgaacaaactagagctctggccctcatctgggagcaggcagaccagccactagcagccaaaaggaggaagggattgataaatagagagaatgtgggaggagggcaggaaggggattgctgtagccatctccaaccccccaaaaagtcaggcaggagaagtccaattaccctttcagagtaatttccgctctataaagtgatgacttacttcaccgcccagaggtttccatttgccaactggggatagacaagtcctgcaggggagggagcgacttactgactcttcagctccctggaggggaaaggaacctgggcttggacgtgggctgtgctctgacttgcttttttactttgtgactcacctgccctctctggacctcagttcactcatctatttaaagaattctgaggcctagaaaaactctggggattggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaaagaccaattaagtgaatctcctgttttccagatggagaaacaggcacagaagggaaagtgacttgtctgaagacacacaggaggagaaaaacagagtccaattagaatcaaaccagactttctactgaactagaaagtgaatgtctgtgttaatggcagtcaacactccatcattattgtccagttggtgggcagcctgtttgtttgaagggcatgagttcctagaagtatgcctcccatcctccctctggaccacaatattcccacagtctagcaccaatgctggtgcctcgtgggtattcagaatattttggaattagtgaatgaatggattcccagtccagattcactcctctcttattgttcttggcaccttcccacattggtactgtcatctccacttgcctccctgtctgatgtgttctttctgtccttctgcaaactcgatcctcaggtccccatttcatgttcacatccaatcccaccacttctctttctactttagtttacagggacctcattagcttacgtacttgggcaagtttcacaactttcttcttcttcttttatttatttatttattttttcttgagacggagtttcgctcttgtcgcccaggctggagtacaatggtgtcatcttggctcaccgcaacctccacctcctgggttcaggcggttctcctgcctcagcctcctgagtagctggggttaaaggcatatgccaccatgcccggctaattttgtaatttttttagtagagacggggtttctccatgttggtcagggtggtcttgaactcccaacctcaggtgatccacccgccttggcctcccaaagtgcttggattacaggcgtgagccaccacgccccgtaacaactttctaagcctcagttttcttacgtacacaacagggatagagatagtaacagggtcttcagaaagctgtcttgaggatcagcaatgccagatgagcttggtgagcacatattacacattcagtgcatggtagtggcgtcaaggtcaacattgtcatcacctcacccagttccacagcctgcaagaatttccgtatgctctgctcactcttctagaacttcagttcccactgaatgtgttcaacaggaccagtcaattttttgtgaagggtagaagtgtgtgtgagtgtgagtgtgtgtgtgtgtgtgtactagaggcctgccatttgggaagccctaacctatgaaggtatcatcaaaacccttgcccacgtggtgccttacagtttacaaagtacttttttctttattatgaaccttacaacagcacttcagcgcagatgattttagttttgccttatagatgaggcaagttgggtatcagagaggggaggtgatttgtcacaacagtaagtggaatatgcagaattactataaagatctaagatctggaaccagctccactgactgtcatatattctttcctcagcatctctatacacaagacaaaaggataattagagggcaaagaagaaagtgtttccattgaaggaagtgctaggaagaaagcaaaagtcagggatattgggcaaggaagaggtagcttggaagatgctcacaggtgtcaccatccaggtggcacttctgagtgtgggctcagcatctacagcttcatttccatcccatacctctcttttatctctgaatttttttatatatatatttttaactataatttaagttctagggtacatgcgtacaacgtgcaggttagttacatatgtatacatgtgccatgttggtgtgctgcacccattaactcgtcatttacattaggtatatctcctaatgctatcactcccccttcccctcaccccacgacaggccctggcgtgtgatgttccccatcctgtgcccaagtgttctcattgttcaattcccacatatgagtgagaacatgcagtgtttggttttttgtctttgtgatagtttgctaagaatgatggtttatagcttcatccatgtccctacaaaggacatgaactcatccttttttatggctgcataatattccatggtgtatatgtgccacattttcttaatccagtctatcattgatggacatttgggttggttccaagtctttgctattgagaatagtgccgcaataaacatatgtgtgcatgtgtctttatagcagcatgacttataatcctttgggtatatacccagtaatgggatggctgggtcaaatggtatttctggttctagatcactgaggaatcaccacactgtcttccacaatggttcaactagtttactctcccaccaacagtataaaagtgttcctatttctccacatcctctccagcacctgttgttttctgactttttaatgattgccattctaactggtgtgagatggtatctcattgtggttttgatttgcatttctctgatggctagtgatgatgagcatttttgcacgtgtctgtaggctgcataaatgtcttctttcaagaagtgtctgttgatgtcctttgcccacttgatggggttgtttctttttttcttgtaaatttgtttgagttcgttgtagattctggatattagtcctttgtcagacaggtagattgcaaaagttttctcccattctgtaggttgtctgttcactctgatggtagtttcttttgctgtgcagaagctctttaatttaattagatcccatttgtcatttttggcttttgttgccattgcttttggtgtttgagacacgaagtccttgcccatgcctatgtcctgaatggtattgcctaggttttcttctaaggtttttatggtttcaggtctaacatttaagtctttaatccatcttgaattaatttttgtataaggtgtaaggaagggatccagtttcagctttctgcatatggctagccagttttcccagcaccatttgttaaatagggaatcctttccccatttcttgctcttgtcaggtttgtcaaagatcagatggttgtagatgtgtggtattatttctgagggctctgttctgttccattggtctatatctctgggtacaagtaccatgctgttttggttactatagccttgtagtatagtttgaaatcaggtagcgtgatgcctccagctttgtttttttgcttaggattgtcttggcaatgtgggctcttttttggttccatatgaactttaaagtagttttttccaattctgtgaagaaaggcattggtagcttgctggggatagcattgaatctacaagttaccttgggcagtatggccattttcatgatattgattcttcctatccatgagcatggaatgttcttccatttgtttgtaacctcttttatttcgttgagcagtggtttgcagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggttgagacaatggggttttctagatatacaatcatgtcatctgaaaacagggacaatttgacttcctcttttcctaattgagtaccctttatttccttctcctgcctgattgccctggccagaatttccaacgctgtgttcaataggagtggtgagagagggcatccctgtcttgtgccagttttcaaagggaatgcttccattttttgcccattcagtatgatattggctgtgggtctgtcatagatagctcttattattttgagatacgtccgatcaatacctaacttattgagagtttttagcatgaagggttgttgaattttgtcaaaggccttttctgcatctattgagataatcatgtgatttttgtcattggttctgtttatatgctggattatgtttattgatttgcatatgttgaaccagccttgcatcccagggatgaagcccacttgatcatggtggataagttttttgatgtgctgctgaattcggtttcccagtattttattgaggatttttgcatcgatgttcatcagggatattagtctaaaattatcattttttgttgtgtctctgccaggctttggtattaggatgatgctggcctcgtaaaatgagttagggagaattcccactttttctattgattggaagagtttcagaaggaatggtacgagctctgccttgtacctctggtagaatttggctgtgaatccgtcaggtactggactttttttggttggtaggctattaattattgcctgaatttcagagcctgtgattggtctattcagagattcaacttcttcctggtttagtcttgggagggtggatgtgtccaggaatttatccatttcttctagattttctagtttatttgcgtagaggtgtttatagtattctctgacggtagtatgtatctctgtgggattggtggtgatatctcctttatcattttttattgcgtctatttgattcttctctcttttgttctttatgagtcttgctagtggtctatcaattttgttgatcttttcaaaaaacaagctcctggattcattgattttttgaagggtttttcgtgtctctaactccttcagtcctgctctgatcttagttatttcttgccttctgctagcttttgaatgtgtttgctcttgcttctctagttctttaattatgatgttagggtgtcaattttagatctttcctgctttctcttgtgggcatttagtgctataaatctccctcacacactgctttaaatgtgtcccagagattctggtatgttatgtctttgttctcgttgatttcaaagaacatctttatttctgccttcatttcgttatgtacccagtagtcagtcaggagcacgttgctcagtttccaggtagttgagtggttttgagtgagtttctaaatcttgaggcctagtttgattgcactgtgttctgagagacagtttgttttaatttctgttcttttacatttgctgaggaatgctttacttccaactatgtggtcaattttggaataagtgcgatgtggtgctgagaagaatgtatattctgttgatttggggtggagagttctgtagatgtctattaggtccgcttggtgtagagttgagttcaattcctggatatcctcgttaactttctgtctcgttgatctgtctaatgttgacagtggggtgttaaagtctctcactattattatatgggagtctaagtctctttgtaagtctctaaggacttgctttatgaatctgggtgctcctatattgggtgcatgtatatttaggacagttagctcttcttgctgaattgatccctttgccattatgtaatggccttctttgtctcttttgatctttgttggtttaaaatctcttttatcagagtctaggattgcaacccctgtctttttgttttccatttgcttggcagatcttcctccatctctttattttgagcctatgtgtgtctctgcacatgagatgggtatcctgaatacagcacactgatgggtcttgactctttatccaatttgccaatctgtgtcttttaatcggagcatttagcccatttacatttaaggttaatattgttatgtgtgagtttgatcctgtcattatgatgttagctggttattttgcttgttagttgatgcagtttcttcctagcattgatggtctttacaatttggcatgtttttgtagtggctggtaccagctgttcctttccatgtttagttcttctttcaggagctcttgtagggcaggcctggtggtgacaaaatctctcagcatttgcttgtctataaaggattttatttctccttcacttatgaagcttagtttcgctggatatgaaattctgggtggaaaattcttttatttaagaatgttgaatattggcccccactctcttctggcttgtagagtttctgccgagagatcagctgttagtctggtgggcttccctttgtggataacccaacctttctctctgactgcccttaacattttttccttcatttcaactttggtgaatctgataattatgtgtcttggagttgctcttctcaaggagttctttgtggctttctctgtatttcctgaatttgaatgttggcctgccttgctaggttggggaagctcttctggatattatcctgcagagtgttttccaacttggttccattctccctgtcactttcaggtacacctatcagacgtagatttggtcttttcacatagtcccatatttcttggaggctttgtttgtttctttttattcttttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcgaacttcctcctttagctcggagaagtttggttttctgaagccttcttctctcaactcctcaaagtctttctccgtccagctttgttctgttgctggtgaggagctgcgttcctttggaggtggagaggtgctctgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccccgtttgcctgggtatcagcagcagaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctcaactttctcagatctcaaactctttgctgggagaaccactactctcttcaaagctgtcagacagggacatttaagtatgcagaggtttctgctgccttttgttaggctatgccctgcccccagaggtggagtctacagaggcaggcaggcctccttgagctgtggtgggctttacccagtttgagcttcccagccgctttgtttacctagtgaagcctcagcaaagcctcccccagcctcgctgctgccttgcagttcgatctcagactgctgtgcaagcagtaagcgaggctccatgggcatgggaccctctgatcctggtgcgggatataaactcctggtgtgccgtttgctaagaccattggaaaagcgcagtattagggtgggagtgatccgattttccaggtgccatctgtcacagttttgcttggctaggaaagggaattccctgaccctttgtgcttcccgggtgaggcgatgcctcaccctgctttggctcacgcttggtgtgctgcacccactgtcctgcacccactgtccaacaagccccagtgagatgaacccaatacctcagttggaaatgcagaaatcacctctcttctgcgtcagtcacactgggaactgaagactggagctgtcctattcagccttcttggaactgccctatctctgaatttttaaacatgctccccgataaggtgaattctcatttggatattaatatgaatcctagctttccctgtgttttcttgtgacagcaccctgactttgttcaggggtttaccccttaggaaatggcaaaaactaagcataagccaatcattgtttggcaatggttggtttagagttatggacgtgagatctagatgtgagggaaagtgtgctgaagagcttctaagaatggtttcctctctctcttatgatggaaacaaagggatagagtccatttctgctactgaaagtgtcaggatatgtggctagaagccttgcaagccattctttgatcaggaccaggttgccatcttgctactgtcctgaggaaggagccaatagatggttggaggcagaaacaagggcattactgagactcagagctgggtgcctgatatgccatatagggatacactctacttttggacttctggtagcctgagataatccattttcttgtcttttaaatgcatttgagttgaggttactgttactagcagccaaaggccacctgactccttgtggctcctacatgcaggctgcttagtgacccaagaagttttcatttatgttgttaatgatctactgagcagacatcagaagtgattagtcacaaataataaagatgaaacatttaagaatgtttggctttttttgataatttagaccaataccccttaaactttatcatgcatcagaatcacctgggatgtcttgctaaaacagactatgggaacacaccactagagttactaattcattagacctatggtgggggttaagaatttaattttctaataagttcccaggtaatgctgttggtgctggtttgaggaccacatttgagaagaactgatttagacaactgtataataatttcccttattttattaaaatataaatacgatttcttgaacaggagaataggaaatacaactacatctagaagtcacacacctggaaacttccaggggaatgtgacttgcattgacttatcctgtgtattgcagaaataaaggttgagacttaaggctccaaatatctactgtttcagactcagagagctcaggatataggtacaatgattgaaagagagcacaaaatgggtcttctgtctttatatcctgctggaggtagcagctaacatgtttgagagatcaaaaagatactattattattaatgcatcatcatcatcatttacactttataaattccttctacatcataatctcatttgatctttattgtaatgatgatcattatgataataaatagaatgagggccttttctcaaatatggcagataggaggaaggactagcttgcagctcctgcctggatggacagagcagcgtggggagactcatattgtgaacttttgctccaagaactactgcaggaacataccaggaagccaagagaatccacagaccctttgaaggaactagatcactgctgcagtctccctgagatgacaaaaaactgtgagtcagcttgctttctcaacagaggggcttgtgatctggggcaagttttcagccctggctaccagcttcctggaaataggcttggtgctgttgggaggccatagtgagagtgagactggcttttaggactgtgggctgcatgggagcagagtgaggcctgtgactgctggctttcccctacttccctggtgacctgtatgacttaggagaagctgccataatccttctgggaacataactccattggcctgggaaccataccccattccccacagcagctacagcaagccccacacaaggacaggctgagctctgacatgcttatccctgcccccacctggtgttctttctctaaccactctggtagccaaagacaaaggtcataatctcttaggagctctatggccctgcctaccacctgagaaacctgaatacttcatcaggtgtccctagggtaagtctgcatcctcccaataggaccacagctgacacactcttgaaagtgtcacctcctggctggaagccaacgaatacaaaccagcacactaaacaaaaacacaactgaggaccatcacagagtccacttcactaccctgctacctccactggagcaggtggtggtatccatggctgccaagacctgaagacagataacattacaggactctttgcagacactcttcagcaccagcctggagctctgctgggtggctagactcataagagcaaaacaatcactacatttcagctctgaggaagccccattcctagggaagggggagaacaccacattaagggagcaccccatgggacaaaggaatctgaacagtggcccttgaatcccagatcttccctctgacatagtctacccaaataagaaggaatcagaaaaacaattctactaatatgacaaaagaaggttatttaacacccataaaagatgatactggttcaccagtaatggatccaaactaagacaacatttctgaattgccagaaaaagaattcagagggctgattattatgctaatcaaggaggcaccagagaaaggtgaagtccaacttgaagaaataaaaaatatgatacaggatatgaaaggaaaattcttcagtgagatacacagcataaataagaaacaatcacaacttctggaaatcaaggacacgcttagagagagcaaaatgcactggaaagtctcagcaatggaactgaacaagtggaagaaagaacttcagagcttgaagataagactttcaaattaacccaatccatcaaacacaaacaaaaaagaacttcaaaaaatgaaaaaagcctccaagaaatttgggactatgctaaacatccaaacttaagaataattggtgctcccaaggaagacaacaaatctaaaagactggagaacatatttgagggaataatcaaggaaaacttccccagccttgctagaggtctacacatccaaatacaagaaactcaaagagcacctgggaaattcattgcaaaaagatcatcgcctaggcacacagtcatcaggttatctaaaatcaggacaaaggaaagaatcttcagagctgtgaggcaaaaacatcaggtaacctataaaagaaaacctatcagattaagagcatatttctcaacagaaatcctacaagctagaagggattggggtcttatttttagcctgcttaaacaaaagaattaccagccaggaattgtgtatccagaaacactaagcttcataaatgaaggaaagatacagtcttttctagacaaacaaatgctgacagaattcaccattaccaagccagcactacaagaactgctaaaaggagctctaaaccttgaaacaaatcctcaaaatacaccaaaatagaacctccttaaagcataaatctcacaggacctatataacaataacacaattaaaaaaagaaaaccccaagatattcaggcaacaaatagcacaataaatagaatagtacataacatcttaatgctaacattgaatgtgagtggcctaaaggctccacttaaaagatacagaatggcaaaatggataagaattcaccaactgagtttctgctgtcttcaggagtctcacctaacacataaatgtaatttaaaggggtggaaaaagatattccatgcaaacaatgccaaaagcaagtaggagtagctattcctacatcagacaaacaaactttaaagcaacagcagttaaaaacacaaagaggtacattatataatgattaaagaactggaccaacaggaaaatatcacacttataaatatatatgcacctaatactggagcttccaaatttataaagcaattactactagacctaagaaatgagatagacagcaacacaataacagtgggggactttaatactccactgagagcacaagacaggtcaacaagacagaaaatcaacaaagaaacaatggacttaaaaactataccctaaaacaaatggacttaacagatatttacagaacattctactgaataactgcagaatatacattctattcatcagcacatgcaatattctccaagatagaccatatgataggccacaaaacaagtctcagtaaatttaagaaaattaaaattatatcaagtactctgtcagaccacagtgaagtaaaactgaaaatcaactccaaaaaaaaccctcaaaaccatgcaaatacatggaaattaaatagcctgctcctgaatgatcattgggtcaacaatgaaatcaagatggaaataaaaaaaaatctttgaactgaatgataatattgacacaacctgtcaaaaacctctgggatacagcaaaagtggtgctaagaggaaagttcaaagcattaagtgcctacatcaaaagtctgaaagagcataaattgacaatctaagaccacacctcatggaactggagaaacaagaacaatccaaatccaaacccagcagaagaaaagaaataacgaatatcagagcagaattaaatgaaattgaaacaagaaaatacgaaagataaatgaaacaaaaatctggttctttgaaaagatcaataaaattgatagactattagtgagattaaccaagaaaagaagagagaagatccaaataagctcaattagaaataaaatgggagatattacaactgatatcacaaaaacacaaaggattattcaaggctactatgaacacttttatgcacataaactagaaaacctagaggagatggataaattcctagaaatatacaaccctcctagattaaaccaggaaaagatagaatctctgaacagaccaaaaacaagcagtgagattgaaataataatttaaaaactaccaacaagaaatagtccaggaccagaaagattaacagctgaattctatcagacattcaaagaagaattggtaccaatgctattgacactattccaaaagataaagagggaatcctccgtaacattctatgacaccagtatcatcctaataccaaaaccagggaagcacataaccaaaaaagaaaactacagaccaatattcctgatgaacatagatgcaaaaattctcaacagagtactagtaaactgaattcaacagcatataaaaaagacaatccaccatgatcaagtggatttcatgcaagggatgcagggatggtttaacacacataagtcaataaatgtgatagaccacataaacataatttaaaacaaaaatcacgtgatcatctcaatagattcagaaaaggcatgtgacaaaacccagcattcctttataattaaaactctcagcaaaatcggcatagaagggacatactttaaggtaataaaagccatctatgacaaacccacagccaacattatactgaatgggaaaaaagttgaaagcattccccctaagaactggaataagagaaggatgtctgctttcaccacttctgttcaacatagtagtggaagtcctagcaagagcaatcagacaagagaaagaaatacagggcatcaaattggtaaagtggaagccaaactctctctgtttactgatgatataatcatatacctaaaaaactctaaagactcatccaaaaagctcctagaactggtaaatgaattcagcaaagcttcaggatagaaaattaatgtacacaaatcagtagcactgatatacaacaacagtgaccaagctgggaatcaaatcaagaactcaatccctttcacaatagctgcaaataaataaatacataaaatatttaggaatacctaaccaaggatgtgaaagacctctacatggaaaactacaaaacactgccgaaagaaatcatagatgacacacccaaatgaatatatcccatgcctatgaatgaatagaatcaatattatgaaaatgaccatactgccaaaagcaatctacaaattcaatgcaattcctatcaaaataccaacaccattcttcacagaactagaaaaaacaatcctaaaatctatgtgggaccaaaaaagagcctgcatagtaaagcaagactaaacaacaaatctggagacatcacattacctgacttcaaactatactataaggccatggtcatcaaaacagcatggtattggggtaaaaacaggcatatagacaaatggaatggaaagaagaacccagaaataaagccaaagacttatagccactgaccttcagcaaagcaaacaaaaacataaagtgggaaaaggacaccctattcagtaaatggtgctgggatattggcaagccatatgtaggaggatgaaactagatcttcatctctcaacttatacaaaaatcaactcaagatggatccgggacttaaacctaagacctgaaaccataaagattctagaagataacactggactaagaaaaacctttctggaaattggcttaggcaaagacttcatgacaaataacccaaaagcaaacacaacaaaaagcaaagatacataaataggacttacttaaactaaaaagcttctgcacagcaaaagaaacaatcagcagagttaactgaaaacccacagagtgggagaaaatcgtcacaatccatacaactgacaaaggactaatatccagaatctacaaggaactcagactaatcagcaagaaaaacaaacaaacaaacaaacaatcccattaaaaagcaggttaaggacatgagtagacaattctcaaaagaagatatacaaatggccaacgagcatataaaaaatgctcaacatcactaactatcagaaaaatgcaaatcaaaaccacaatgtaatactacctcactccagcaagaatggccataataaaaaaaacaaaaagtaatagatgttggtatggatgcagtgaaaatgaaacacttttacattgttggtgggaatgtaaactagtacaaccactatcgaaaacaatttggagattccttaaagaactaaaggtagatctactgtttgatccagtaatcccactactaggtatatatctagagtaaaataagtcattattcaaaaaagatacttgcacatacatgtttatagcagcacaattcacaattgccaaaaatatggaaccagcccaaatacccatcaatcaataagtggataaagaaaatgtagcatatatataccatggaatactgctcagctataaaaaggtatgaaataatggcattcacagtgacttggatggaattggagactattattctaggtgaagtaactcaggaatagaaaaccagacatcgtatgctctcactcatacgtgggagctaagctatgaggttgcaaaggcataagaatgatacattggactttggggacttgggggaaagggtgaggggtggcgagggataaaagactacacattgggtacagtgtacactgctcaggtgatgggtgcaccaaaatctcagaaatcatcactaaagagcttattcatgtaatcaaataccacctgtttccctaaaacgtactgaagtaaaaacataaacaatttttttaaaagaatgaagatgaagaggaagaggaagaagaattgtcagcagaggataagtagaagggagtggattacttccattgtacagatttgaaaactgaggttgtatgacttgtccctgtcatatagcaagtaaaccctgagcaaagactttaacccagttttgtcttccactaaattctgtattatctctactaaagcagctgtgtgttggcacagctattaactatgaataaaaaaataaaatttagaaattctacggctatcataccttccaaaataaggctggcatcttgcttcagaaacacctcatatgccctacgaacccaccaagcatcttcccccaaccaggaacaaagaccccaaaactaagatagaaaaatctagaagtcaaaacaactattataatgttgtaggagactctttcatgacctcacctgagggctattaactattattaagataaagctcaagagagcatgcctttctcattaccaagcccattatataattcagagacctttttttttttttaacgacagttataagtgacagaaggcagtgtggtagcaaaggaagagacagaaaggtcatcaaaagcagacacaggagaactcgaacttgctctggagatgatttaaacattttgagatggacattttgatcaaaaggaaagacagtaagaaaaacaagaaaaggtctgcctattgccctaatcctcctgagtaaaccaggagcattgcagagctcactcaacctctcaggctgacctggtatagaaaaaagagcatggtgatcttgaataggttactaaacatctctgagcttccacttcctcagctttcaaatggaaggtcataatgcctcctttgcagcactgtaaggactggcgatatgatatagaaagatcttaatagtttctggtctaaagtaggccctaaataatagagggctcttgttatttttatgataatggcatatatgaggcatggggcaaagaagaggctctgaggggatggctaccaggtttggcttgggtaaacatgggcacctcctatttaatccagcctttgagaccagcttcaaatattattttctagagtcacaatttgctaaaccaagcagttcatgggccttacttcacaaattattactttggtactttaaaagcctcccataacaagaaccagccctctacaaggcaggcaaaggaacagagctgagttccataaggaaataattctctcaggggttacagatgcatggactatattttatggccagtgctgggtgaatttttagcaaggagagaaaggccattttttttcctctaatcacacagtggcatagcttagatgcttagatttggactgaactatatcttgccctaaaactctattatggatgttacctctcatttcattgacagaatatttctaacatggatgggattccctggtgaaagaaaaagaaaagtcattcttggtgggggacagattaggcagctcctattgttttagtggcttctgcctatgtctgcgtccctcaccagagtgggaaaaatatcttcttacaaatttttgttatagacttacctaataggtgctacgtgaaatgtaactcgattgactggaaggcaagtatactgctgaaacacagtactttactatttcagccatagatcataaccaacataggtgaaaatgtttccatgggaaaatgtggtcagagttcccttccgtgcaaaggtgccagaaacacctttcccttgcaggctttcactgctttctgagaggcagcctggtgtaatggaaagagctctatatttggagcaagatgacatgagttccagttcagctttcctgctctgagttgaatgacccttaaactctctgagtctcagtttccttccctgcccaaaaggcataaaaactcgtactcccttggtgttttgtgaactgaaatgttggcagaatcactttgaaaaccataaagttccctgtacaatgttgaaaacttattagtacctttctgatctgctgggatgtgagcccctcacatgactttcacatgaaagttggcattccttctcagggttacatggccaaggtacccattcctctctgtagagatatgcctgttctgtctctaagcagcctaggcatctctgatccaaaaaagcttcaacttccaaaattcataagctccaacaaaaagagaactgaagaggagaagtggagcactggtataaagatacctgaaaatgtggaagtgactttggaactgggtaacaggcagagcttggaatagtttggagggcacagaagaagacagggatatgtggaaaagtttgaaacttcctagagacttgttgaatggttttgactgaaatgctgatagtaatatggacaatgaagtccaagacaaggttgtctcagacggagatgaggaacttattgggaactggagcaaaggtcactcttgctatgctttagcaaataaactggtggcattttgtccctgtcctagggatctgtggaactttgaactttacataaatgatttagagtatctctgacagaagaaatgtctaagcagtaaaggattcaagaggtgacctgactttttggaacacatgtggacagtatgtgctgtagatcatgctccttcttggggccctcccaacagagcgtaggctgcagggtggaagatgtggcataggaggaagcaccagagcatgggagcaggtgacttcttaggagttaggacttcctcatcggccctcccctcatccagtctgagagcctttgcaccacagatggcttctgccctttttggccactgtcatatatataatcaagcatcagattgaaactcacatccaaaagctatgcatctcatctctaatagtggtccatgaatttgagtgattgtggtaacctggggcagcaggcacaggagaattattaagcaagccacctgccttcaatagcagtggcagaagaagtattgagaattcccagtgtgccttctcactcctttatcctgcaggtgccagcttaagcaaaactcctactatactgtctccttgttgaaaggtcgttaataattatccatgggcctgagaaaaatgtcaaagctctttacagtcaccctaaataatgcaatcccactcaccattccagacccactctctccacaaaccatcccttacagattcattcacaaacagacctcccaatttcacacctctctgctttttcctatgctattccctcaacttggtagatcatttcaccttatcctcttgcctgtccccattacagtccttcttattgacatcctactcatttctaaggtccggctcaagtgccatcttctctaggaagacctctgttatccaaaacctcctcacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaaaactgcttgaacccaggggtcagaagttgcagtgagctgagatcatgccactgcactccagcctgggcaaaagagaaagaacttgtctcaaaaaaaaaaaaaagtgacaaaagatgtgaaagtaaattttagtttcagaaatactgcgaaagtaaattttagtttcagaaatacaatttttgattcatcatgatttttagtatgcatccctagcagatttgtttaagcttctgatgagctcagcccgatatctgtatcctagatgctcagatccaattctggcccaaagcaagtgattagagaatgtctgatgacacaaagaccaatgaaacagaatagcaagtccagaaataaatccacacatttacagccaactaattttcaacaaaggagccaagaatacacaacagagaaaggacagtgtcttcaataaacggtgctgggaaagctggatattgacattcagaagaataaaattggactctcacatcatgtacaaaagtcaactcaaaatgaagcaaagacttaaatataagacctgaaactataaagtaactagaagaaaacagtggaaaagttccatcacattggtcttggcaatgattttttagatatgacccccaaagcactcacaacaaaggcaaaaataaacaaataggattgcatcaaactaaaatacaaaggaaacaatcaacagagtgaagacaaaatctacagaatgagagaatatatttgcaatccatacatctgataaggggctaatatctaaaatatataagtaatttcaaaaacttagtaagaaaacaaattgtccaattaaaaaataagcaaaggacctgaatagacttttctcaaaaaaggcatacaaaaggccaacaggtatatgaaaaaatgctcaatatcactaaccaccagataaatgaaaattaaaactgcaataagaaatcacctcacactgttagaatggctactatcaaaaagatgaaaagtaaatgttggcaaaggtgtggagaaagaaaacttgtacactatttatggggatggaaagcagcatgagaattcatcaaaaacttaaaactacaacttccatatgatccagccaatcctactactgggtatatgatatagtttggctctgtgtccccacacaaatctcatctcaaattctaatccccatgtgttggggaggggtttgatgggaggtgattgggtcatatgggtggtcacccccatgctgttctcatgatagtgaattctcatcagatctgatggtttaaaagtgtggcacttcccacccccctcactctccctttcctaccaccatgtaagatgtgccttgcttctcctacaccttccaccactactgtaagcttcctgaggcctcccaagccacatagaactgtgagtcaaacctcttttctttataaagtacccaatcttaggtagttctttatagcagtgtgaaaacaactaatacagaaaattggtaccagaagtgaggcactgctacaaagatacctgaaaacatggaagcaactttggaagggggtaacaggcagaagttggaacagttttgagggctcagaagaaggcagaaagaattggaaaagtttggaacttcctagagacctgttgaatggttttgactgaaatgctgatggacaaggaagtccaggttgaggtggtctcagatggagatgagaaacttattgggaactggagcaaaggtcactcttggtatgctttagcaaagagactggaggcatttttcccctgccctagagatctgtggaactctgaaattgagaggatgatttaggttatctggcagaaaaaatttctaagcagcaaagcattcaagaaatgacctgactttttttgaaagtgtacagtcatatgtgttcacaaagagttggtctgaaattggaacttatgtttaaaagagaagcaaagcataaaagtttggaaaatttgcagactgcccatgtggtagaaaagaaaaacccattttttgcagagaaattcaagccatcagctgcaaaaaaattgcataagtaaagagaaaccaaatgttaatagccaagacaatggggaaaatatattcagggcatttcagaaattttcacagcagcccctctcatcacaagcctggaggcctaggaggcaataatggttttcatggctgctgctctatgcagccttgggacatggcaccctgcattccagacgttccagctccagtcatggctaaaaggggccaaggtatagcttaggctgtcacttcagagggtgcaagccccacgtcttggtggcttccacatgatgttgggcctgtggatgtgcagaagacaagagttgaggtttgtgagcttctgcctagacttcagaggatgtatggaaatgcctgaatgtctaggcagaagtctgctgcaggggaagagccctcatggagaacctctactaaggcaatgcagaggggaaatgtggggttggagcccttacacagtgtcaccactggctcactgcctagttgagctgtgagaagagagccaccatcctccagaccccagaatagtaaatccatcaacagcttgcatcatgcacctagaaaagctgcaagcactcaacatcagcctgtgaaagtagccatgggggcttaccctgcagagccacagggatggagtacccgaggccttgggagcccaccttttgcatcactgtgccctgggtgtgagacatggagtcaaaggagagattattttggacctttaagatttaatgactgtcctgttgggtttcggacatgcatgtgacctgtagcccctttgttttggccaatttctcccatttgtaatgagggcatttacccaatgcctgtatccccattgtatcttagaagtaactaacttgcttttgattttacaggctcataggcagaagggactttctttgtctcagatgagactttggacttggaatttggggttaatgctggaatgttgtgaaggcacaattgcattttgaaatgtgagaaggacatgagatttgggaggggccaggggcaaaatgatatggttttgctgtatccccactcaaatctcatctagagttgtaatccccacgtgtcaggggaggggcctggtgggaggtgattgggtcatgagggcagtctcccctatgctgttctcatgatagtgagtgagttctcatgagatcttatcgtttaaaagtgtggcacttccctcctcactctctttcctgccaccatgtaagacatgtcctgcttccccttcaacttccaccatgtttgtaagtttcctgaggccttcccagccatggggaactgtgagtaaattaaacctcttttgtttataaatcacccagtctcaggtagttctttatagcagtgtgtaaacagactaatacagtatatattcaaaagatatgaaatcagtacgtcaaggggatatctgcacttccatgttcattgcagcattagtaacaatagccaagatatggaatcaacctgagtattcatcagtggatgaatggataaagtgtgatatatatatatatatatatatatatatatatatatatatatatatatatatatataaaatagaatattattaatccttaaaaagaagaaaatcctctcatttgctatatggatggacctagaggacattatgttaagtgaaataagctaggtactgaaagacaaataccatacgatctcacttacaaatgaaatctaaaatagtcaaactaatagagagtaaaatcatggttactacatgttaccactttgggtactcaggaaatgttggtcaaaggacacaaaattttagttaggaagaataaatttaagagacctattgtacatcatggtgactatacttaataatatattgtatgcttgaaaattgaaaagagaataaattgtgtgttctcattatgaaaaattagtatgtgaggtaatgcatatctgaaatagtttgatcttagccattctacaatttatacatatatcaaatatcatgctgtataccataaatatatataatttctacttatcagaaaaataagtaactaaaacaagaaaatatctgatgaattaatgaataaatgataaaatgaatgagccaaacaggagtcaagaaataggccagaagactcttcaatatgagaataaccttttcctctcaactaaattagagttctcctgatattcctttttataacacctatcttccattcatagcacctctcatgatttgaattgcctacatatgtctgttaagtcaatatctgtcagcttcatttgataatcccccaatagcggggaccatttctctttttattccttgaatactcagcacctaggacagagcatgacatgcaactggcactaaatacatatttattaaataaatgaatacacagatattttaagttattaaaaaacagaaaattaatccctgatggaatttaaagacaaagtgtagcattttattcaattactatgtattaatgtaagctgagacacgttcttggccccatctcatccattagtctgagttaggggcatagtctgtgttctcattttctcttccactctctgtcgatggaaacacttatcatctgtgttgtgtttgtccatgttcttgtcttctggcctactaggctataatctccaaaatggaaccacctttcattcgtatttatgtcttaaatgtatggccatggtactcaaatatggcaatagggcataatcacaattctaaagttcttttgacatatgatacagaggccctctgcttactgatgtttacaatttttttattatactttaagttctagggtacatatgcacaacgtgcaggtttgttacatatgtatacgtgtgccatgtcggtgtgttgcacccattaactcgtcatttatattaggtatatctcctaatgctaccactccccctccccccaccccacgacaggccccggtgtttgatattccccttcctgtgtccaagtgttctcattgttcaattcccatctatgagtgagaacatgtggtggttggttttttgtccttgtgatagtttgctgagaatgatggtttccagcttcatccacgttcctacaaaggacatgaactcatccttttttatggctacatagtattccatggtgtatatgtgccacattttcttaatccaatctatcactgatggacatttgggttggttccaagtctttgctattgtaaatagtgccgcagaaaacatacgtgtgcatgtgtctttatagcagcatgacttataatcctttgggtatatacccagtaatgggatggctgggtcaaatggtatttctagttctagatccttgaggaatcaccacactgtcttccacaatggttcaactagtttactgtcccaccaacagtgtaaaagtgttcctatttctccacatcctctccagcacctgttgtttcctgacttttcaatgattgccattctaactggtgtgagatggtatcgcattgtagttttgatttgcatttctctgatggccagtgatgatgagcatttttgcatgtgtcttttggctgcataaatgtcttcttttgagaagtgtctgttcacatcctttgcccacttgctgatgggttgtttttttcttgtaaatttgtttgagttctttgtagattctggatattagccctttgtcagatgagtagattgcaaaaattttctcccattctgtaggttgcttgttcactctgatggtatttccttttgctgtgcagaagctctttggtttaattagatcccatttgtcaactttggcttttgttgccactgtttttggtgttttagatatgaggtccttgcccatgcctatgtcctgaatggtattgcctaggatttcttctagggtttttatggttttaggtctaatatttaagtcttcaatccaccttgaattaatttttgtataaggtgtaaggaagggatccagtttcagctttctacatatggctagccagttttcccagcaccatttgttaaataaggaatcctttccccatttcttgtttttgtcaggtttgtcaaagatcagatagttgtagatgtgtggtattatttctgagggctctgttctgttccattggtctatatctctgttttggtaccagtactatgctgttttggttactatagccttgtagtatagtttgaagtcaggtagtgtgatgcctccagctttgttctttttgcttcaggttgtcttggcaattcggactcttttttgtttccacatgaactttaaagtagtttttccaattctgtgaagaaagtcattggtagcttgctggggatggcactgaatctataaattaccttgggcagtatggccattttgcaatattgattcttcctatccatgagcatggaatgttcttccatttgtttgtgtcctcttttatctcattgagcagtggtttgtagttatccttgaagagttccttcacatcccttgtaagttggattcctaggtattttattctttttgaagcaattgtgaatgggagttcacttatgatttggctctctgtttgtctgttattggtgtataagaatgcttgtgatttttgcacattgattttgtatcctgagactttgctgaagttgcttatcagcttaaggggattttgggctgagacaatggggttttctaaatatacaatcatgtcatctgcaaacagggacaatttgacttcctcttttcctaattgaataccctttatttctttctcctgcctgattgccctggccagaactcccaacgctatgttgaataggagtggtgagagagggtatccctgtcttgtgccagttttcaaagggaatgcttccagtttttgtctgttcagtatgatattggctgtgggtttgtcataaatagctcttattattttcagaaatgtcccatcaacacctaatttactgagattttttagcatgaagcgctgttgaattttgtcaaatggcttttctgcatctattgagataatcatgtgatttttgtcattggttctgttcatatgctggattatgtttattgatttgcatatgttgaaccagccttgcatcccagggatgaagcccacttgatcatggtggataagctttttgatgtgctgctggattcggtttgccagtattttattgaagatttttgcatcgatgttcatcagggatattggtctaaaattctctttttttgttgtgtctctgccaggctttggtatcaggatgatgctggcctcataaaatgagttagggaggagtccctcttttcctactgattggaatagtttcagaaggaatggcacaagctcctccttgtacctctggtagaatttggctgtgaatccatctggtcctggaatttttttggttggtaggctttaaattattgcctcagtttcagagcctgttattggtctattcagggattcaacttcttcctggtttagtcttgggagggtggatgtgtccaggaatttatccattttttctagattttctagcttatctgtgtagagttgtctctagtattctctgatggtagtttgtatttctgtgggataggtggtgatatcccctttatcattttttattgcgtctattagattcttctctcttttcttctttatgagtcttgctagtggtctatcaattttgttgatcttttcaaaaaaccagctcctggattcattgatttttcgaatggttttttgtgtctctatttccttcagttctgctctgatcttagttatttcttgccttctgctagtttttgaatgtgtttgctcttgcttctctagttcttttaattatgatgttagggtgtcaattttagatctttcctgctttctcttgtgggcatttagtgctataaatctccctcacacactgctttaaatgtgtcccagagattcttgtatgttatgactttgttctctttgatttcaaagaacatctttatttctgccttcatttcgttatgtacccagtagtcattcaggaacaggttgttcagtttccatgtagttgagtggttttgagtgagtttcttaatcctgaggtctagtttgattgcactgtgttctgagagacagtttgttttaattcctgttcttttacatttgctgaggagtgctttacttccaactatgtggtcaattttggaataagtgcgatgtggtgctgagaagaatgtatattctgttgacttggggtggagagttttgtagatgtctattaggtccacttggtgcagaactgagtttaattcctagatacccttgttaactttctgtctcattgatctgtctaatgttgacagtggggtgttaaagtctcccatttttattgtgtgggagcctaagtctctttgtaggtctctaaggacttgctttatgaatctgggtgctcctgtattgggtgcatgtatatttaggatagttagctcttcttgttgaattggtccctttaccattatgtaatggccttctttgtctcttttgatctttattggtttaaagtctgttttatcagagtctaggattgcaacctctgcctttttgtattttccttttgcttggtagatcttcctccatccctttattttgagcctatgtgtgtctctgcacatgagatggatatcctgaatacagcacactgatgggtcttgactctttgtccaatttgccaatctgtgtcttttaattggagcatttagcccatttacatttaaggttaatattgttatatgtgagtttgatcctgtcattatgatgttagctggttattttgtttgttagttgatgcagtttcctcctagcatcgatggtctttgcaatttggcgtgtttttgctggtaccggttgttcctttccatgtttagttcttccttcaggagctcttgtagggcaggcctggtggtgacaaaatcccttagcatttgcttgtctataaaggatttttatctctccttcatttatgaagcttagtttcgctggatatgaaattctgggtggaaaattcttttatttaagaatgttgaatattagcctccactctcttcggcttgtagagtttctgctgagagatcagctgttaatctgatgggcttccctttgttggtaacccgacctttctctctggctgcccttaacattttttccttcatttcaactttggtgaatctgataattatgtgtcttggagttgttcttcttgaggattatctttgtggctttctctgtatttcctgaatttgaatgttggcctgccttgctaggttggagaagttctcctggataacatcctgcagagtgttttccaacttggttccattctccccgtcactttcaggtacaccaatcagatgtaggtttggtctgttcacatagtcccatatttcttggaggctttgtttgtttctttttattctcttttctctaaacttctcttcttgcttcatttcattcatttgatcttcaatcactgataccctttcttccagctgatcaaatcggctactgaagcttgtgcattcgtcacgtagttatcgtgccatggttttcagctccatcaggtcatttaaggacttctctgcattggttattctagttagccattcttctaatcttttttcaaggtttttatcttctttgcgatgggttcaaacttcctcctttagctcggagaagtttggtcttctgaagccttcttctctcaactcctcaaagtctttctccgtccagctttgttctgttgctggtgaggagctgcgttcctttggaggtggagaggtgctctgatttttagaattttcagcttttctgctctgctttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacatcgaatattgctgaacagcaaatgttgcggcctgatcgttcctctggaattttcgtctcagagagttacccagctgtgtgaggtgtcagtctgcccctactagggggtgcctcccagttaggcttctcaggggtcagggacccacttgaggaggcagtctgtctgttctcagatctcaaactccatgctgggagaaccactactctcttcaaagctgtcagacagggacatttaagtctacagaggtttctgctgccttttattaggctatgccctgcccccagaggtggagtctacagaggcaggcaggcctccttgagctgtggtgggctccaccccttttgagcttcctggccactttgtttacctactcaagcctcagcaatggtgggcgcccctcccccagccttgctgctgccttgcagttcgatctcagactgctgtgctagcaatgagtgaggctccatgggcatgagaccctccgagccacgtgcgggatataatctcctggtgtgccgtttgctcagttggaaatgcagaaattacccatcttctgtgtcgctcacactgggagctgtagactggagctgttcctatttggccatcttggaacccaaatttctataatttttttcttttacttggccttgttgttctccaaaatttattcatgtttacataatggtggtacaaacagaaatgcaactttggtttcacaatttacattgataacttcacattcatttgacagtttatttctgacaattacagattttacctccttcttgaacctatggacattatatgagacacagtgatatgtgtaatgatgtgtaatgtatacatgtggtaggaaccctgggaactgtaaacatacagtgaagccctggaaggtgaataattaaaatttggtgaaagctaactgctcttgagattttaaagccagaaaacctaagagtatctcttagagaaaattttatgtatgatccaggatttggaaagaccattcactgcaaattggtaaaatcagagaactccactgactatcatagaatcagaagagctgaggcagatgccctgtgggaacaggatactaacatagaatcaaaaaatcaaacctctagagataggtactaagagtaatggtagtgattcaaaccagagagtaagatctgagccatgaaagcagggattaggagagtaccatttgtaaatacaaggcactctagtgtgttcttttacatagttatcacaacaaaccttccaggatactccagttttacagagaatgggatggaggctcagagaggcttaataatttgcctaaggtcatactgcttatcagtgtccatatcaaaatttgaaacaagatctgtatgaatccaaattaagtgttgaacccactatacaacaatgcctcctagttgatgcttaggctgcctgtagctcatctgataggaatgaataagagctatggtccccattcctggattagaaataaaggaaagaagaaagggagggaggaagggatggaggaagggaaagagggaagaagggactgagagggagaaaaagaaagaatgaaaaagacagaaagaaaggaagaaaggagcaaacggaggaatgaaggaagggaatgaggaagaaagggagggaggaagcaaggaaagaagcgaggaagaaaggaaggaaggaaacaaggaaggaaaagaaagaaatttggggttctacactagcactactgaaaataaatcttcagggatgtgtggcccatgactttgtattttaaaaactttcttcaggtgattctcatacccaagggcagagaaccacagagctgaaggggactcttgctctagttgtggtgttcgacttgtgaattctaaattcactcaagttttaaggttttgtgtcctaagtctcttgcctgttggatctcagagtgaaaattcttcatgttgatctaaggaaaagtacttaaaattatattccatgctttgttaattctaaaatgcacaatttttgcctttgaatatgtctgaaattgagatgcatcctacaagtgatgatgccatacagtttccatcaaccaggcagcaaatatcatcacctgtgcttatgtgaatctggctgtcattcctggtggtccacctagataagtacaatccttaacatttcaggccaaactccttaagaattaattttggaaagaaaatggatcctgacagttgtctaacaaacttcattgacaagaactagtaagataaagaaagcagcatcattcattaaaacttgaaagaaaacaccagaaataataatggagtcttcttttaagaaaaacagcaataaaaatgaacaacatactggtacatgctacgacatggacgaaccttgagaactaagtgaagaagcaagtcacagaaaaaagcagatgtggcatgattccatttatatgaaatgttcagagtaggcaaatcaacaaagacagaaggtaggttagtggttgcatagggttgaggaaataaggggaaagtaaggagtgactgctaatgggtatagggtttattttggggtgttgaaaatgtcctaaaattgaccgtggtgataatcgcacaactctgtcaatgtgctatcaaattgtacactttcaatgggtgaagttgtatggtatgtaaattatattgcaatgaagctattaaaaaaatctatgagggagggaaaaaaaaaagaaatgtaacattactaactgtctggctggcagagaggacaatagtatatggaaaaaaaatttaaagactgagtcaaaaagtggtttagaaaaggcagacactgaatgcaaagttttatgaacatttgaacacttattttgtttatagcacaagaacgatgcacagtagtccccactttccagggaggatatgttttaagaccccagtggacgtctgaaaccacagatggtaccaaccctatatatactatggttttcaatctaataacctggacggctactgagtgactaacgggtgtatacgctggacaaaggaatgcttcacaccctgggtgggatggtgcaagatttcatcacactgctcagaatggcgtggatttacaacttatgaattgtttacttctggaattttctatttaatatttttggactttagctgattacaggtgactgaaactggagaagacaaaaccatggataagtggagactactgtattataaaaatataatcagaataaatgagccctttcaatgagctccaaaaatataattgataagaaaccattgggttatagttcagttggcatcattttctttgctttataaatggcacataaaataaagtgtctcttaaaatgaatcgcatcttgatgtgataaaatatagcatgtgactcagctacatgagactgcttttccagccaatggctagctgtaaaatactggctgtattctttaccttctccattcctaagatttcatgtctctatattgggtctatttctatggatcctcttggctctgagatattctagttctaattcaaatttttattcatgtctggtgggaaatttatcatttattattagatcctgcatcagatcacaggcttaaaacataaggaaaagagaaaaaaaatcatacccatctaaatttatcttttactgaaagaaacatgcaagaagaaagaggtaaaatgatttcttgcagttttccctctaattatatgtagagtttcacttcttaatcctctctgaatctcagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacaggtgaatttagtggattttaaaattcctttttagttgctggtcttcataagagattatttttgtctaaaatgcaagcacccatttttatcttgcagtctccaaaataattgagaaattggaaatgcctaaatgtccagcactaaataaatgattaataatatttgagatacccatattatgaaacagtatatgaacatgaaaatttttacaaaagtttttcccctagttttgaaactaggggaaaaagtttgaatgccacatctaatgaaaaaaaaaagcagaaaaaaatatacatgacattctccactatataaggaatggacattgaggaaagaaatatgccaaaattatgatattattaggctggtatagttgtaacttactcatgtttctgcattcccattctataataaatgtgtcatactcttttctatcataaaattaattttacacaattttaaacatttttcttataacagaaaataaaatgtgatcatagtaggaaatttaggcgggaaagagaaaatataaatctgccagatctaacacaaagaaaataactgataatataacattttggtatatactcttatagtcattttttcttgaacagatggacaatacagagagtgagaaagggtctataatcttatgagccactgcaagttctacccaacctataatgagagcaggccccaacacatggaacactgggcccttgttgccatggttttcctagttaactctattgctttaatcatagttaattggactgagagtaaaaacttaacccaaggtgatccactcacatttattgcccaggaattacagctgatagtactaaggtaccaggaagataggcagtggatgaaacactgcaccagattggggaagtgactctaaccatgggcagatggaagcagagacagaacaaggcaagagctgatgggccctccaaagactgagagaatagcacatgtggtgtctaataacttctcagattctgtgtcttcttgatttataagatttccccttcagctctcaataaagacatccacatccctaaaaccagaagtgctttaattatataccattttaaattaaatttttaaattttaagataattgtagattcatatgcagttataagaaataatagagagagaccttgtgtactctttacccagttttctcctgtggtaacatcttgcaaacctataattcaatatcacagccaggatactggtatcgacacagtcaagaaacagaacattttcattaccacaattatttctcatgattttttttatagtcacactactttcctcttgctcctgctccacatactattttgtaaaatgttttctgcaatagtaatatttaaatgactgtcttttatttcctttttattaaacattatttaactgaaccctaataaacacccttacatgtaaatcttttataaataacttttcttagaataagcaaattctcttgatacatattgctaatttgccttcaagaaagtttgacaaatttacattagcaccaacaaaatatttttaatgaaataaaaaggtaacataaacttttagtggtttataagatcttctgagatccatcatttacaagggtgcctaataaattctgccacttcaattgagcaagttgttttaaaatcagatcagttcaagttaatatgtttattacttttggtcaaagatcattgcaagggtattagaaaaaaatataaattcaatgttaactttaaaaacaacttagaaaaacctgaacaaagccaagttatatatattctgggaaaaaaatagattacattttggagttacaaaagagaatcatcagtcccatccatcaaaatgttgttttaagactattatttttggctgggtgtggtggctcatacctgtaatcccagcacttctggaggctgaagtgggctgatcacctgagctcaggagttcaagaccagcctgggcaacatggagaagcccttccaaaaatacaaaaagtagctgggcatggtggcaggtgcctgtaatcctcccagctacttgaggggctgaggcaggaggattgcttcagcctgggaggcagagattgcagtgagctgagattgtgccactgcactacagcctgggtgacagagcaaaactctatctcaaaaaaacaaaacaaaacaaaagactattatttttggtataagcttgatgttcacctttggaatcatccagctgaaaaaaaaatcatatagtatcttgttggacagaaatatttttggaactctcttttaaattgattataacctctactagataagcaccctaaagaccatccggcacattttttggttggttggttgtttttgcatgcatagaaaaaattgaaagaaaatgaagagagttcttcataatcacaggtatagagattatagcataagggcagtctgattgcttgagctcaggagtttgagaccagcctgggcaacataacaaaaccctatctgtatgaaaactacaaaaaaaaaaaaattagctgggcatggtggcgtgtgactgccgtcccagctattctgaaggctgaggtgggaggatcacccaagcctagggaggctgaggctgcaatgatccatcattttaccactgcactctagcctgggcaacagagtgacaccctgtctcaaaaaaaaaaaaaaaattgtcagtctaatacacactgttgttgatcatggtgtacagtagttttgcaacagattgccataaaaaaagtttaacattcattaaaaaacaggagttccacaaggtaaaataactcactgctgtgccatatcctgtgttgttcagttgaaccagtgatccctttcaaattataatcccttaagataatagtctttattttccttgtccctctctccagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttgtgaggttcctgttggtatcttctgctgagctacagggcccagtggacaaacactgatgagaacgtgaagttcagaattcgttactgcccctcacaaagcctatgtgaccgggagtagatgactaaacccttcactgtcttttctcctattagaacataacattgtctagttctaacacagagaacagaaaatgagttagcaatgtccaaattccctgcagaaacacttgggaatcgactgccaaaacgaccttctctgcaaattcaggggttacactcaaaactctccaagggcacttagtggctgacatactagtattctatgatgaatcagccctgaaatttgcactgagacagtcatactaaggaatatgcagtgtctggggagaaatgaggtatttggatgaaaaatggagtgtccccagatatttgggggaggagataggagcaacccagaaaccctccatgtctaatcaagtgactcatcttgtgacagcagtccccatcctccattccacctcaccaaaaaaagatgttttgcatcgaaaatcaccattcacaaagaacacaaggtgtcttagacatgatagtagtaggtctttccctgaaatgctccacctttgctcctttaaaatttttagcagttatttgctatgtttccccatgccagaaaaagaggaaaggatgatttgggttcttctatttatgtagatgtcacgtgcttttgacagttccatcacatttctgacagttacatatttttattcatgagttatttgatggattggttctttgggggcatcagaagtttacactggaacaaagttaaggacatacagacctcatacttttgacaccaaaggtcacactttggattaggcgctaggggccaggcctctagaccacaggagcaaacacaacagcagtttttcagaagccaaatcggtgggaaacaaggcaaagatgaagctgagagagatttttgtggctgttttaaggacataaaaagtcatgaagcataaaaaggcctcatagggattcccccttattcccagctgcagaaacattctgcctagctcattttggaatctgagccagaagacccttggtgagagtgccaatggcctgctcctggcccagctacctgctcccctgtatgccttagaaaacatggacaggcccggctcctcctcagccttgggacagttccttccagcttcccagccagcttcccagagatgttcttggactgcaccagcaactgctggcctagagtcagtccaagtgcccagatgtgccaatgcagagccagggatgccagacttggcatgggggtccgcctgcctggggccattggcttgcctcaagaaaatagagtttgagagggcctggagtttcagcccctagatggggctgggtgccagtggttttctgtaattacacatggtcctaaaatgtgttgttctcaaaattggaaaatgaactgtggattggagtctccacatgtacccaccattctatacaaaatgcttcatttgggaatattcaattctttttcatttccttaaagcagtcatttttcaaacattttcaaagcagtagaatccacctttccaagaaaccttacacatatatcccacagggaaaccgacgagattggggcttacacaccctactccattaagcaatttcattgtatagcttgtcatcccctgaggtctaaccacagtttccttaagcttgcagaaaaacttatttgaaagcaatagtttaagaagttttagaaacaaatccattctttcttaaaatccaatgttttcatgaccaatttttagcagaaaaaaaataagaaaattcatatttttttcagtgtcaaaattcattcaacaaacattttctgaatatagggtacaagccaggcactgagctgggcattgaggatgaagagatgaaacacaattctagcatctaaatagaccttggttggtgagtggccttgggaaagtcatttgcatctctctgagtccctgtgaaatcatgaaggaaaaaagtgctaacaatgtgagaactgatgattattgtcatatggactcttcattttacactaaaggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggtaaaaactgaagatactgagtattagatgatggggcaaaaggactgcagaagttgggtattcagagcctcatagaaatgacgtgaaaatccaatataccagtttggtatacaatgagttcccattacagatgacattccttatggttttcacagcatttacactgccagtatcatatttaaccctcccagcaagcatctagatagggtaggagggacattgtccccatttcagaaatggagaaactgagtctcagagatgtaagctgacttgcccaatgttgaacaactgataagtagcagagcctggataccttagtgagtcaggggctatgagttctaccctttctgttccagttgagtaatgtattgagttaagagataggcatgggtctgaattctgtcctaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagaggtaaatagcatctagggtcatgagtcctataccagagatatgcacaggagcttgtttaatgattatagcaaccaggtaacagactttttactaaatttccaactctctgatgagaaaactgcgactctgagagtccaagtaaccagctcccaggtcatgcaatcaatacattgagggagcaggcgttgaactcttgtcactgactccaaagccctctttgtactttacccagctgcccgcagcttctatgagagtgtctgcaggcacgccggctggagggggtaggaataatattatttcatttatgttttatttatgtggtggtgtgatatttatctagcagctttcatctgggaaatgtgaagtgttttataaacaggttcttatttttttctccctccccttccactcctccacctgagtacttaagaaccaaagaggtttccagagaagaccaaggtcacaagggtggacagatgtatatgggatggtggttccccatgtgtggatgcagctgtgtttggtgataacagcaataatctcttagatttgtatatccctctgttgtttactaacctgtttcgtgtccaacttttatttgatacccacaccagtcatgtgaaattggcaagacaagcatcaatttacagaggaggaaactgaggtccagagagatcaattaaactgtctaaagtcacatggcctgacataaaagtagtggagagtcaaactcaggtctgctgattcatacaaaaacagtgttgtgtaatggctaagaggctgaactttggaatcaggctgaattgagtttgattctgatctcctctgtgccttcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggtaggtggagatctctcaataaacagcagctataactaagatcccaaccaaggtctctttccactataaccagtgtctgagaggagggcttggagctcacatacacctgagagggtctatttgcaggcaggtcaaggcgcccggtttacctgagctgccccccaagctgaggttctgtgtcccattccctcccctccaggcatcagcctctgcgtggggtgcattctcaggcaggctgtctgaggcagcagctgcgggaggcatacactcccaactcacccccacacaccctgcccacctgtctccactccttgcctctggcagccccactttgcctaggagaaaagcagcaaacctgcgtcctcaggtgctctcctcttagctcccccaccccaggatgcagccaaagaaaaccaaagcactctgttttctaagccggagccaggagcgattcccgtaaggcactgcctggcttaatggggctgtgtctgggccttgcctctaagccaggctctggcagtcaggaggctgccctcctgcctggctccatcagaggccgtggcatttgcttaaggtgattcaaagtcgaggccaaggggacagagatggcaggaggcttggttctggttctgtctgtactgactcacagcatgactctggacatgaccctgaccagctccaggcctcagtgcctctgtctctctacctttactaaacggcagctgcttctatgtcagtaattctttaccctggctgcatatgagaatgacctgggggagggttttgttgttgttgttttgattttttgagactgagtttcactcttgttgcccaggctggagtgccatggcgtgatctcagctcattgcaacctctgcctcctgggttcaagtgattctcctgtctcagcctcctgagtatctgggattacaggtgccccccactatgctcggctaatttttggtacttttagtagatatggggtttcaccatgttggccaggttggtctcgaactcctgacctcaggtgatccaccggcctcagcctcccaaagtgctgggattataggtgttagccactgtgcccggcctggggaaggttttaaaaatgaacacctgtgccccatccccataaattaccattgaactggcttggtataggggtctgggcagcagtacttttcagaagctcaataggtgattcctgtaggcaaccagggtctagatccatgaccctaaataaatgctgagatccctgtaagcttttgcatttaaggattctatcaaagagataaaggagtaagaaacagagacttctagaaggagaaattctgatgggttttggtctttaaagtatcatcaaattaagttgtctcattggacagatgggaaaattggggccccaaactaagggatgagtttaaaaccacataatgagcggctggtggcctggtctagaacctgtgtcatctgaagcaaaccacaaaaatgtcagtaataaaaagatcagaggaggaggaggaggaagctgaaaataaagaaagaaggaaatgcaaaaaagggcaaataaaaaatgaaaaaaaaaaaacagaaggaagtaaaagaaaggaatgggaggtcagggaagagaaaggggtaaaacgtagagggacaaaaagaaataaaagccacaactgaggcacgagcaactcggatagtaccctgtgagtcagggcagctctgagccacacttggctgtacagttcgtatttggcaattgcaacccgggcaagagctctgatcccagctggggccccaggcccagggctggagcctgcgtggggacggtctgactcacagctgctacttcctcaccctgtttccagcctcttgctcaatccaggcaggaggcaggatagatgctcttttgcaaggtgatcccagcccagagggccctgcaacctttatgaaacgattctggttaggtgtaggaaacaaatggggcagcagaccctgtactcccaacatgctgaacagcaagatgactcccaaagcggccagccctttcctgcctccaggcctttgtttgatgcccatttccactggagtgcccttccccacagataccctgcctcacatggcatctgaggcctcccaagtctggccctgtaatatctctctactcatggttcccctccatgctttctacactacccataaagccatttattaaaagtaatggcaaaaaccacaattaccaaccttaagacatttactactcctcacctttgcttatgatgtgctcactctcctacgcaatggaacccacaggcatctttcaaatcccacaaacacacaaaaatcccacatgaaatgtccctgctttaattccatctttccaaatggctttctcttatcactacagtcaaaatcattctctctcttctacaactccacatcaagtgttcagtctgtcccctgtaatacttagcactctgactcttttatctcagaccacaaaattggaagttctacgtgaccagatttacatccatataacgtctctgggcataaactgtgaactgtgacagatctgggtttcaatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaacactcaaaaactcattccctcctcctaatatccctgagagataggcaggaattcctgtccctgacaaatgcagaaagatccaacctgatgcaggtgggttgggacaaggtaaagttagggcttaaactctcctgccctttagaggccttgctgtaagactctgctgcctgctaggagaggaagcagtcttggctcccgttatgaatagatgtcagccttttggcacaatgcaacccaactgtcagcctaaaggaagccgcatgtactcagggaaaccctgtctgctctgcctttcacaggaagccaggatgtggagccaggagagaaggggcattcaaagggcctgggagacccttggtgaaaacaatcagttggtttcaacatcccagagagattctcaatcagggtgagtctcaaatattagtagacataaaaatcacctggggagagtgtaaaaaaataaaaattcccagaaattctggttcagtcattttggggccaacctagtcatttgcattaatcagcatgcactccctgatgattctgatataaatgaatcacatgttgcaaaatgctttagcctgttccctaatctaaatcttatctctctcctctcagcctggtctacccctccttcagaattaccttttactgagaacactgagaaaatcaatgtgcatatcccattccctttattctgccatcacccataatttcttcctgtcctgtttcatctgggccgtatagactaggagagggatgtttgagagagtaacagcaaccttcaacctctataaaaccagctcctgcccttcctgactccttgggactcagttctatcagttactgtatttcctttcctctggaattgcttctcctccaatctttcccatttgggggactggccccaacattcagagtcagtggtcttggttaaaccctctgtgcctatatccgctctgcccactgtcttttcctccagcaccccctacaacacaaacacacatcactcataacccatggatcccacctctcagtacctccatcctcactgccatcattctagtttagtcttcatttctcccaaaaacactgtagttcaataaggctagaaaagacagtatgagagggtaagaaatcaagctggagagtgcgggagcaggaacttttagtctcagattctcaggaaataggaagaactgtgaagaattgtaggggaggtagagaaaaggaaaatgctatctagccaaatttgtagctctatccataatgatatgtccaaaagattctgaagtagcctgccacatatacatatacatatacatacacatatacatatacatacacatatacatatacttaattgcaataattttcagataaagcaaaggcatccatgaagactttgcttccttcttctagtagctcacagagaccaaagttggcacacagcactctcctaacactaaagactctacaactccttcttcatgggatgtgtgaaagcacagagaggtgagtaaggtgtttttttagttaacttccttcccatgcctcatatctgttacatagaaagggcatatcactgggaaaataatgtgttttgctcattttatttattttctttgagaaaattggtgtcagagttaagggggataagtgtttttcatactcttttatttaaacatagaactatttattcctaataaaatctcatgggaaaactcaacaggtaaaggtaaaacattctgctagtagcaggaacttagtaggctcaagctctcatccactagaatttgcctctctcagtgattcctggggtgcctcaaagtatgcctacagtctaataacatcattttgaaaactgctgagctagtccacacacattattttgaaaggagagaaggagagacttatcagagctcatatatcaagtcacagtggaactgggatttgaacccttgattcctgactctcctcccagtactccaccagctagatgactctgctatgtgttctggggtaaaaagcccaactcaggagtcaaagcaaaaataaagatcccaaggcctggtgccctaaaacttggcatcaccagggatgaggtttggggccagacactctgatctaagctgcatgggcacagtcagtggacgtgcacaacctctgcagggcagtcaagggcttttcttgggattttatggcttacagtggaaatccattaaattattagtgtgatgaagagaatgggaaaggttgcagcaaggttggctagcaggactgaaggtgaaaagactcactacagagaaagttcaggcagcatcagaggatgaggccaggtaagacagagaattgaaggcttcccctggctgcatatcttaaaagatgtctgagttaggcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttagatgtttatggcattcacctctaaagagccctagcggagggagggaagtccagagagtactggcccagtggtcactgcttgttttccttaacttttctcttctgaacttcaatttcccttcctctgttatgtcactgttatcctcggcagatattttctgcacagaaacgatgtgtccaggacagtgttaggctttgcaatggaacagaaaacaaatgtgagaaaaatattccactctcaaaatgtttataagcatgtagctctgagatgtagcagaaagtgcattggcttggggatcaggaagacttgagcccaagtcgaacttttaccttcctaggctggtgtgatggataaatcacttcagctgggcctccacttttccatgcatgaggtagggaccacagcacttacctagcacacctagccacattgccagtactcaacaaaggttatagcctcttttccctctcttagacagtctgggaaagtcaaatttggggtgaacctgtcttttgactttctgaccttaggcaaaaattgaagttttagaaaactgctatggaaggacaagatatcagcctccaaagggtcttctattagctatgggtggatgcatctaaaggtgtaagttgttcagtgagcattgaacgaatgaacgaatgaatgaatgtatgaataaatgaataaatgaacaagctacccacagtcaaagttcaacatgcctgtgacttatttactttttagtttttataatttagcacagattacctaatcactttatcactatagtagttacattagttcacttaactctcatgtccttcttatgtatgatggaaaaatatgcagtggtagatagaatgctgaatatgtattatctctcgtaatgataccacagagacacagtgttgctgtgaaaaatatgtataatatttttctcaagaaaatccttacctatgagaccctatacgtggaaggtgaattgtttccttcaaagaggcaacttggtggatgttaagaagacagggaggacccactttgggatctggtgtcaagagtctagtcctatcattgtcacaggtttgctgtgatcagaagccggtcctttccatagtaaaaatcattctattgtgttacatggtatttacgaaagtgtggaacacatcagaatcaaatcatttaatgcaaaggaagcctcccacactttctaattttcttatagtgcttcaaattaagtcatgaaggatggcttgttttagtgctaatatgtccttgacacctctgtaacattcgccagcctcccttttttagaagagagagaccaaggctctggctcagaacattccagaggcaacagtatctgtctagaattttataaaattcttttgttttcactgtattgatttttagagttatcttctatttatggcatgtaatcctggttttccatttaccagtagtgttacatatttccattttgaaatcattgattttaaccaaaaataaaaaaagaaagaagaaaagaaagaaatgagtcaatttcaagaaaaacacattaagttaataatatcccaggtatggcaaaattgtgaaggtgatgctcagatgagatgcaggagacactgtgcttgttgattttccagggtctttcgaggagggaaactgtgagattatctgtgcactgcaaaccctgaaactgccagccagaacattctaatggagattaaatgaacttcagttttcatgacagcttctgggaaaattagtttgtataaagtgatacccagatattcatgagcaactattatctttaattggtgcttgtaagagagaaaaacgggtctatagagactgaaaaggctaaagtgccctttaactttagaggccacagaaaacagcccacactgcccagaggccaccccagcaagaggctgagggcctatgtgttcttcgagctcccccagtctgcgcctctctgctccctggccaagaagagagacaaggccagctgcacaggctggcccactttcgcgctgctgagatctctgagccaaagtgagctaggggcccggattcaggcctcttcccctgctctgtccccactctcagtttgaaatatagcagagcaggaaggtgaaaccaggacaaccctaaactgtagagaatgggtttaagtgaatgggaatgggctttcctctcccgactctgtgcggtccacctccccaccccgtccccaccccaggccatcagagctcacagaagacctctggctgaagctgacctctgggaaagctattggatagtgctctgaagtcactgacagaaaggaggatatcccagctctggagaaggaaggaaaggatgatggatttttccatggatttaacattcactgaacaataaatggggtcagctgaactaaacaaacaaacaaaaaaaaccacacacacacacaaccctgcatctgacagctgagtgacaagagctgctggctgtggactgaggataggcctcggggtgcagaggtgcagagagggagagataattattcaggataattagcgtcttgggttagaggctgctagttctgggatgcacatgtgtgagtatactgacccatcatttgcatgcatcatcaactcacagcatggcagcaccagactgggcaaaaataattggcattcatccatccaatcctctcttcaacagcactgcattcaacacttaccatgtacatggctctgtgctatgtactgaggatacagtggagaacagttcagacactgtccctgccctccacgtacttcatcttccagcaggaaagataaaaatatgaataaataattggaatgaagcacgaggagtgctctgagttgagtgctcaagtcctacctcacctttggtaaaaagcttccaagagactgggaaaattttatttatacttctttgtcttgagtttcctcactggtgacaaaagttggggtggaggagaggtcctacatccatggtttttaagctgtagggctctttaaaagtgcccagagggctggacatggtagctcatcccagccctttgggaggctgaggtgagaggattgcttgagaccaggagtttgagcagcctgggcaacacagccagactccacttaatttttcgtaaataattaaataaaataaaagtccccagaggctgttgagaaggaggcttcaaccagatctctaagccacctgtttttattttgtttcatacatcggaattttctaaaattgtgttggaacaaacagttctgctgaaatagagagagagaaagtgaaaagaggttgacaatgactcaatttgacgatgaccaatattccttctagctctagctttctaagactttagtgaccctaatgtccctaagtttaaccccataactcttttataagcaaatataaatctatgaccagacccacatattgaagtaattttctacccactttatccacttgtttttctgtaaacacctagaaagctgaagtcattagtatatatgtacgcacacacatatatgtgtacattatattatttatgtagaatacatagatacagaaaaaatgtagatggagaggtatgttaatatgtttactactgggtttaactaagtgttgttaaactccatgatatattgggaggccgaggcaggtggaccacgaggttaggagatcgagaccatctggctaacatggtgaaaccccgcctctactaaaaaaatacaaaaatattagccgggcgtggtggcgggtgcctgtagtcccagctactcgggaggctgaggcaggagaatggcgtgaacctgggaggtggaacttgcagtgagctgatatcatgccactgtgctccagcctgggcaacagagcgagactctgtctcaaaaaaaaaaaaaaaaaaaaaaaaaagaaaagaaaaaattcagtgatatagtggttaaaagtacagaattttgagagtacatcactacaacttcctagatatgttatttgggagaacatatttaatttttctatatctcagtctcttttttgtaaaatgggaagagagatgcctaacttttcagtattcttgagttaaatgaaagtgtctaatttttgcagtattcttggattaaatgaaagtatttatagcacacagcatgatatgtagcaggtaatagaagcctataaataatatttcccttcccttttatggcccttcctaaatgccaagagatggatggccacgagtttctttatgtgtccttcttgctctcaatttagatggagacatggctgcttggaaattgtccttaaaggaaccacaggttggtacagaagtgaaagtactataatttggaagatcttcaaaaaaactcttttgacattgtggcatgtaatttccatacctttttcctacgtgtatataaagaatgtaatatcttctgtctttgagcaattataaaccctcaggatgaaagaggcagagtgatagtacaaacaaataaaacttcataacaaacaagcaaacatagacctctcatgtggttcttggggttttcaacagctctgaacttgcatttgcttcaagcactgcccagttctaagagactgtaattgaatatacattgttcgatttttgttttttgcactagtcccattacagagctataagcatagaaatagaatgaccatgtccaccctgttgatcagtcttttctttcagcaaatgagtactgtgatcccactatggaccatatcctatatcatgggtgctgagatgaagggcagagtccctgtccacacagtactctcagactaatgtcagcacacagcccccaccccatcttgagtcccaaaattcagctgtgatgttgcagacaagctggagactttcagataagataacaatacaaacagcagcagtagtagcagcttctacttaggagggcttactaatatgacagaatctactctagaccctttacattttctgtctctgattctctccatacctctgcaagacaagtatggtcactactttttttttttttaactgcactgaagagaaaaagaaaaaagtgatttgcttaaggtagtgcagtcagtgagtgactgagccagaattacataacagggttcccttttcctctggggaccaagagagcttatggaaggacatgggccatttctcagcaagatgacactgcacagccacaggccaatgacttggcattgctttggcccaggaagttcaactcagagaagtagactcaagcagcccaggaattttaggtccggaaaagtcatgtttcctcagagatgcttgcttttgtcaagccacgggttctgacagggctatattctcagaccattcagctcatcctcaatctttagtacctaccagacacaaggttcacccatcttgatacagtgagacacagaagaaaaagccagggcttgagtttgtctgagcctcagtttcctcagatgtaaaaaggatatgagaatatacccttctacacaagaatgatgtgataacgaaataaattatctaaatggcctggcacatggtagatacttaagaaatgctcattctcgttcatttaatatttattgagtgtctactatgagccagtcactcttgttggtgcttagaacataccagtcagcaaaacatgcaacagattgttgcctttatgcagattacattcaagggtagggaagcagttcttacccgactctactttatgtgcttccttgccaggcaatgacaaaggaacttgcctcctggtgaagcctacaacctgtgggactggaggagatctcccctcctcttccatatgtgttaaatgttgcaatcagaaagacccttggaaactccactctggggcatttgttacactgtaaatcccttgccctaaccttattccgtcccacaaaccaatttagagagctgagaccttggatatctcatcagaccagatggacgagaaaatcatctagggagaggaaattcaacaaacatatgctgaatacatctctatgcagagtcctatgcttctggtgctgagaaacaggctgaagcacatacacagtttatttcacaacttatttggaagataattcttttctgaattaaattatgatctatggtcttttttctttactctcaacttagtgtgtttgtgtatgtacatgtctaactgcagaagtaggaagtatgatgatggggatgttgtctgtgaatccaacgagaatgttacaaaatatatggtgtatgcactgcagtgcctttctaaaaatccaaaaagaaattctgaatcctgatcacatctaataccaaggactttggataaggacctttagtactaatttccttattttgcctgggaagctgagcttcaaggaacctaaggaacttgtccaaagttacacagctaataagtaacagaatcaggatttgagcctgggaagtttgacttaagaacctgtatttgtggcctttatattactctgccttcttattccttgaactattaatatgagccaggagcattttcttcttcctctttcttcttagtttactcttcacaacactctaaaaggcacttactattattgccgctttttattgataaagaaacaactgtacaaagcaattttaaggtcttgctggttaataagtagcagtactcggatttgaacccaggatggtctggctgtaattctattatttgtaactattgtactatactgccacaggccagtgaggtcccaagtgggttgcaattaacattgtaaatgttaattgtgtagttaacaatgtgtaaatgtgacttacacatttctttggcttatatacattgcctctcttgcctccttgcaattcattctccacataacagcccagtggcatttgtaaagtaaaatctcattacatcactaactcactagctccttcactcattccataagccttcatgccaggcacttttctggtaactgcggaggcagtgattaataaaatagtcttaccccttacggagcatcaagccagccagtccccagatttccattatatttagaataattccaaaaaccttaacattagacccagtggatctggacttccctatccttcctccctcttcttcttgttcttcccctctctctctcctcccttcatagtaaccttcaataagtttgtctatcagtccatcattccagcttccctccagcctcaagtctttagcacaagtgagctctttcttctggatggttcttccttatacattcattagttttataattcaattgatgtgtttgtctcctactagactgcaagtgccatgtggtcagagctatgccatatcctcttgacatatctgtctttaacctctagcaaaatgtctctgggacctgggaggcattcaatagatattttttgaatagctgaaggcatgaacattatgttaggtgcacagaatttaagtatcaatatttgtgtctggaagggaggtagagagggaaaatagtcagaaagcttctcagaaaaagttaaagttatttaaactacacatcaaaactggtatttggcaaagcagccaggaaagtttccacaagaacaaagaaaaatgtacatgtgttgttatgctaggatggggtagacatagagatatctagatgaactctgggttagtttgtaaagatgaagctgagagagggtgtagggaaaataaggctggaggactaacatgttgagaaccaatgctttaagagagagagagtgtgtccctgcttcaaactcatcccatgagcacaaatcgtccaaacactcgcacccagattccctcttgcctaatatcctctaatctggtatgcatcgtgatgcatttggtcatcttcttatgtctgtctcccctgctatgctagaaagttcttgtgaacaatggctagaacttaatcatcttagcctcctcaatgccttgactgaaaagggcccttggtagaagttcaataaatcttcattaatttaaatgaaattcaagtagaataaaatatattgaggtaaaatcagttatatttttctcatttctccactataccagttatcatcttccactccctaaagtttggctggatcatcaggtgccaggttgagaaaagccattccaaatcaacacaaaggaattacacaaatttacaccaaggagacaaagtagactaccaaagagaaaaacagaaacagagaatgactttgagaaagacacaaataaaatgagaaggagaaaacaagagtctccttgtcaaaatctaaaggagcctgttggagtctcccacagccccagggagcaaagataaagatcccatccctatgagtatcaagctgcatctattacataccacaactaatttaattgttacagcatgaactgacctgccaaacttttattgttgagactatttgagaaggtagctatggagggtaagaaggaaagccatgtctttgtcctccactggcctgggacataggtgtccccttttcattcccttgacttcctctcaattcacacaattaggattcttcatattcctttaggaattccctaatggccaggaaaatgttaaaatgttgggtaatttcttcttcctgagaagcccttttctccgcaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttgattaaccaacgtttttccaaactaactagtcccagaactgtttttatattctacggctcatatattagcattccactggactaatgttctcctgtgtgaactttggagatcaggttaaggagaggtgagcataaccttgacaagttaaagcatgcttcttgggctgggcacggtggctcacatctgtaatcccagcactttgggaggcctaggcgggcggatcacctgaggtcaggagttcaagaccagcctggccaacatggcgaaaccccatctctactaagaaaaaaaatacaaaaattagcagggtgcctgtaatcccagttactcaggaggctgaggcagaaaaattgcttgaaactgggaggcagaggttgcagtgagccgagatcatgccattgcactgcagcctgggtgacagtgcgagtgactgcctcattaaaaaaaaaaaaaaaaaaaaaaaagaatgcttcttggagaaagcaaaggttatgcgtgattttgaaaaatgaaggatgaagaggcactgattaagctgaagacagagggaaggttcggaaagctcatgtgttcatttaacactgcatttaataaatattcattcagtgcctactctgagccagaaagtatgcttggtcttaaagacacagaggtgaccaagagaggcataagccttgccctcatggaacttgcattctgcaggagaagagatgtaagtagaccattgcagagtaatttttctatctggtatgacaaaagagaaggagggtctaaagattaggtaagaattctcccagccaggctgggtgcggtggctcacacctgtaatcccagcactttgggaggccgaggtgggcggatcataaggtcaggagatagagaccatcctggctaacacggtgaaaccccgtctctattaaaaatacaaaaaattagccgggtgcgggggtgggtgcctatagtcccagctactcaggaggctgaggcaggagaatggtgtgaacccgggaggcagagtttgcagtgagccaagatcacgccactgcactccagcctgggtgatagagcgagactctgtctcaaaaaaataaaaataaaaataaaaataaaaataaaaataaaaaaattatcccaacagaatagcaaggaaagaatttgcaatagagagaaccacatgaacaatgatctctttgtcatcctcaaacacatcagacgcgcttccatctcaaggtcttgcacttgctattccctctacctgagatgctctttgttcaggtctctcatctccttccgatctttgctccaacattgcccttttctgacttacttatttaaaactagacagccctttccctcatctagcatagttgtctttttttctgcttttctttttcttctgtatcaattatcaacatctgataaaatatttattttgtacttttttccttttcctgtctccctttccttctagaatcatcttttagagctgagtgaatggtgtctctggattgcatctgcaacctgacgttccagaatgctggctccatgaagacaaggagttttctctctttggttaactgctgataccagtgcctggtacatagtaagaactcaatagatatttgttgaataactgaattggtaagcagataaaaagcatgggagattttaaggacaaagaagagaggtagaggacaagcatttatataccataaactctttgcaaagcacatggattacagaactagtttaagattgatattttgtctattttacagttgagtaagtggaagctcagaatggtaaagtgactaacccagtgccacacatcaaataagtagagaagtccagagtcgaacctaaacctgattcaaatagttaaaatgacataggcctgattaacttttagtgatctcaggtggctctttgggtcttgctcttccatgttaatgcacttctcccctgaactaaacatgtagctttctgaggtggcccaaagtgcatggaactgattgcctcccagtcatgggatggataaatgatggcatggcaacccttggggctggagatgactcagcagaccagagctggaaaaagagcccacctctccccaccctaaacatctcattcattctctaatgtcaggtgccttgctacccccatgctgggacagttaatagctcacccaataaacgggtgtgtaacaaagtctactgcaaggccatcgttacttgcagtatcaagtaatgatacttgcatcaactttggctgatctctgtgctggccacatgattaattccaactggttgttgtcccctgcctggggtcattcagaaatccttcacttcttggctgatagtctacagattcccagtgcttgtgaaaggattcgagagttttcttcctccctcccattcttctttccttcattacttcatttatttattttttcatatagtcatatatagatctagttattcattcattcatggattcatttattcattaattaatttactcaaatatttctatgatactaatttataatctgtattcattcataaatgcatacacagattcagtttcttaatcaactcaggtattgtaagggatatgatgagagttatctcatcttggagaaatcacttaactcctctaagcatcattgtccaattgaaggaggtagacttagagtacaaacctaagccagctagaaccaaacgcctcattcaactcaataattccttgagtttaagatatgtaagacacaacactgccttacaatattttctagtctatttcatatattttccatcccaacctagtgtgattcatatgttttccatcccaacctagtatacacatgcatgtatatatgactgaaatgcaagctttatgaaaaaatccttaggcttgccacaaacacacacacacacacacacacacacacacacacacacacacatatgccccatactgaggagattaacaagtaaacaaatacattcaggataatgtatgtataatacattcaggataatgtttttaagacactgtttctctctctctctctctctctctctctctctctctccatatatatatatatatatatatatatatatatatatatatatttatttatttattttgagacagtgtctcacttcatcacccaggctggagtgcagtagtgtgatatcggctcactgcaacctccagtcacacccttccctccacctgcccacccattcccaccccggaccccaagctcaagtgatcttcccacctcagcctcagtctcctgagtaactgggaccatgggcacacaccaccatgtggcctggctatttttttgtttgtatttttagcagagacagggtctcgccatgttgtccaggctggtcttgaactcctggactcaagagatccacctgtctcagcctcccaaagggctgggattacaggcatgagccaccacactcagcctacatcctattttctttttttaaatgttggctccaatccaataagttgactttacaacctactaatggattatgacctgaagttagaaaactatggtgtagaagatctagagagagaccttcgattacaagtacatataacacaagctggatacttggatactgttttagactcttcactcatcttccacatccagcagccttctacatgtgtaagctctgtctcttacatagccctccagtccatcctccaagctgcagccagtgatcattctaaaatatgcctctgatggaaagtctgtaatagtcttcacttgtctacactataaaagaaaaaaacaataaatgcatctaattccttagtcttgtctggccttgatttctcctccagggtcatttctcactaattctgcttttgtatctcatgttgaatcaatgttgagtcatgcacaagtccttgaatctttcatgttctttcatatgttgggcctttgcttttgaagatttttctgcctggaattcccatttcacccaatactgggctcattccaggatcagctcaatcctttgtttttctatgtagcctttactgacagcctccttagccatcatccccttacttttcacattatcctgaatatatctgtttacttgttaatctcctctgtatggggcccataaggtccagaactttattaatggaaatttctccatccccaggactcagaacagtgtttcacataggttaggtgcttagaaaatatttctaaaggtatatgtagtgacctggatcaacaggatttgatgtgtcaatacctgcagcggaattgattcaccatgcggaaatccaatggcagggggcttaactaatcaagagccctagtctgagtactctgaattttaaccctgcatctgcactgaggacacacttcctacaggctgttcctagccaacgactgggcatagcagggatactaaggcaagcccattctgggagatacaggaatcctcagatggcagactgtcttgaggattcccttaggctgggcagcagcctgggatgcttctgcacagccttccttcccactctccttcacacagggtcagactccccccaacctgatggctcccacccagccttcacagcaaactcccatcttctctcacataggcctttcccttaatacaatcctttgatgttttatcccatctcagcatctgcttctcagaggatccaagctaacacactatcctcaatgtacatatgaaggaaccaaggctgagagaggtcatgtgacttgtgaacaattgataagactgaggttcagttgagtgctggtaaatgtttaacaacttggctctctgtgggaagagaggaaaagtgccgattcatagcactggctgatttccaacatataaatacttccaccctggccaatttcacactaccactgtgatttacctgaacgtggacttgggaagatatgtgtgcagttgtcctcaggagccagacaagctggctgtagtgcacctctgtgaggctgcaagcctaggcttctgtctctctgggtggcacccttgacagccctccccagtttttccccactgagtgctcttctcagttggcggggtggggcgccaacagcctattctgggaagtctctgtccagtcagtgggctggaaaccttgtggacatgcagcttctccctgggttcagggggtggataggggctctcatgtccctaaaaatgtaggctctgccagatggggaatagtcacaggaggcttgtgacatcaaaatggccttggaggacccttctggctgtagcatggaagatggattgaaggagtgaaggcagaagacagcaagaccagtaagaggtggtttaaataagagacataaagtagtggtgtgggaactatttcacgaagaagatgaaggaaggacggttggcaggcagaaggcaggacagatcatactactagttattgaataactgctagttattgaaactgtactgcctgccaggctgtatgctaggcactttctcattttacacccctctcccaaaatgtcaaggtaagagttattatctctgcatcccagatatgaaaaccaagcctcagagagactgtgcctttaataataaccataatgaaacaggtagcaaaaatagtagctaacattcactgagcctctactgtatacatgaatattattatcacctcactgtaaagatgcgattaaacagctaacaaatggtggagctgaaactataattcaggtacttagtctcttggtaaaggcctaagtattcttctctagatgtcattaataattcagatgaagcccccaaatgtgggatatactctcatttctccttctcaccaggatattagaaaatgtataatgcaaaaaaaattaagaaatgattctgagatccatttagcaggtagaaaaccttcctattgggacaaggatgctttgcatttcaattcaatactgtactagtggactagcctatagtgagctcatcacatggaaagagttttggatatttttttaaatttttaaattttaatttttatctttttttaggagatgttaagtagatgaaagaccaagaaaagcgagggagaaaattcaatatatttgagaacaaaggcagccattaacctgtccatcttcagaacctgaatcggtagccaaatctcagcagacagagctacgtaatgccagataaatcttcttgctgaatgagagacccatcctaccagcataaacaacatttgaacactctagcccccagccttaccagccagctctccattctctacacacagagtctttgttgggacactccaggccagttatttcaccatcctgagtctggtccctctctgaggcccagggacatatattcagttcaggtttgaattaaggaaagatactactaccttgatgggggatcaggaccacaggaccaaattgaaccaggcaagactgaaggggccaagggatagaggatccccctcccgaaggagccaactggaaggcaacaattggatggcctgttaaagaagaaagaagcttaggacagggagaatgccactttccagtattacaaaaatatcctttaggcaaggtgaggcctttttttactctgacactatttttttttaaaccaaccctgaaagaaaaatgatagggtcaaggttggtccaaggaacagtaggtagggaagcagatgagaggttcagagctctggagtgtgagcaagatattcttcttctaggcacctgagttaccttctttctaaatcagggcgaaatgtcccttttcatgtttcctgagtagtcagggaagcaacgaaccaaagtcattgggaattagaactaagaatcagacgggcctcgtttgcatgccaatggtgtcactggctagccgtgcaacccatggcaagccactgcaagtctcagagctttggtttgcttgtgtgtgaaaatgacaaatatagtgcaggcctaacagaagcatggtgaacatctgatgatgcaatatgtgcaaagtgcttaacgtagttcctggcacaatattaagtacttcataaatgtttgctgttatgattatcaatcaaaacacagcagtaataaattaaggcatgttattagaccttagctttcctaccagtaaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccagaaactggagcatgcaaggccttggggaaatgaccagcaagttcatagcccaaggtttctctgactggttggagagtctaatgtattccgtcatgccgtctaattcagagtctccttgctttgactgtctgtctcctgcttctgttggctcttgctcaagatgtgaaaagtcattggagatgcttattaccatggggtggaaaagtcagggggctttgaagcagattactcggttcgaatctgggctccctaactttgttgtcttgagcaggtggtttcacgtttctagccttgctttctttatctgaagcatgaagctgataatttctactttccaaagttgttttatgagctttaactgagataactgatatacagtgcccagcacagttcatatagtgggtttacaattaatgttcattctgccccttctttccttatcaatataagaataaccaaatcctatatatttacttaaccctttctctcttattgtataagttttaaattttatatctctatcacctattgttctacaggttttaacatgagggcttttagtctctttttttttttgagacagaatctcactcggtcgccccggctccaggctggagtgcagtggcatcatctcggctcactgcaagctccgcctcccaggttcatgcctttctcctgcctcagcctctcgagtagctgggactaccggcgcccgccaccatgcccggctaattttttttgtatttttagtacagacggggtttcaccgtgttagccaggatggtcttgatctcctgacctcgtgatccacccgccttggcctcccaaagtgctgggattacaggcgtgagccaccgcgcccggctgagtctgttatttctatatcccagcaccctgcattgatctgggccaggatggttgcttgagaaagtgtgctcatctgaatctgtttcactcaaaatcctgtgattccaagtaagttttatttgtttagttacataataagcaacctttgctgaatcctgtaccatcctgacctgtcctgtcttttctggcagaacaagctctgttaggatcactcacatgttctccttttattttttaaaaaaggtatatttttaaaaggaagaaggagatacatcctgagagttttggtaattgtttctttgcaacatttgctgcctagagaaagtcagatatgaacagtaagacactcacaggtcaggattaaatgagatggggaagattggagctgatctccctggagatgaaatggaagctgcaaggactcagatatgattcggtgccactgccccagatgagactgaggcacaatccctggccccacgctggtggtttcctctccctggggcaccatcagctcctactgtagccatcaagtctatgtggtttccccaagggagccacctgaaatcaccttgttctttgctatcatgaccgaggcagagaggggaaagagaccaagctgagcactcaatctggactccagccctccttccctgggtcttctcacttttcttctattctgtctctttttccatctttcacaaccctttctctttccctatttctggcctctccctcttttctcttttagaaacatttactgaattacaagtgcttttgatccatgtggagttatgtccatacggtgagtgtgagtatttggtgtgtgctgtgctgtgggtgctacgtgagtggatgccatctaatgtgtctgtgtctgtttgtgctgggtggatccatgtggcacacggtatgtatatctttacagtatgcctgtgggaaggtggctatgtttacgcatctgtgtgcctgtgctgtttatctatgatacgcctcttgaggcatctgtcatgtgttgagtacaagctgtgtgttgtctgtgcgtggcatgctatccccatggtgtgtaactttgtatgtgttgtggatctactgtatgtgtctgtgtgcttcccgtgtgtgtgtgaccgtgtctctttgttatctgcctttcgttggctgcacatagcttgaatgtccctgttgggtgatgtgctcacatgcatgtttatatgtgttggtatctgtgtgttgcctttgtttttgtttagctggctgaggtgactgcattgtgtatacctgtatgggatggattgcattcatttgtgagtctgcaccctatatgatttctctaaatcccctggctgcatgctgtgtctgtgtggggtatgttgcatttgttgtttgtaggtacaactgcatattctgtgtgttcccctgtgtctctgcctctgtgaaatgtgtctgtgtgttttccctgccagctcctcctccccttcgggtgccccagcctctctccctgccttctcctccccaggctgtgaccactctcagctgacacctccgctgctctggcaacccaagaacagcctggagaaaggtcagctggccgccttccccagggcctgcctggatccttggaccccagtgttgcgtggtgtgggagcgccctctgttggctgtatgggccatgaacaccactggaaacagacttcctctttcccttgctgctcacccctgagacttccagccttcttaataagggactttaggagaggaatgggtagggtcgcctataatttgccgttgaaagcgagatgttttggagaatgaaagagggtgtgaataagtgcactgagatactgagtattcggcagatgcgtcttaagcagatggtgaggaaggcttccctgaccgcctacttgggtctcagccccatgggcataagccaacaaaatgtgtgctagccctcactggtgaaagggtcagctattcccaatttatgtttgaggaagtcagaatctcaaatctatgcttacccaatgacttcacgctttcccttgggaataatttcccaagaccccaatttcccctttgcagcagggacccaaggtggagacccaagggttccagttccagaaagagggaggactgaaatgtttctaggggatttaacagaaagaggtcaaaggcactcttgtgagaagaaagggaatagttatagaggtacccaggacttgtaatgccccaggtgcgtgactctgacagcctcaagaggaagagaaaggtgctgtgtgcacacatgtgggtacatgcgtgcacacatgtgggtacatgcacacacacacacacacacacatatatacacacacacacatcaggaggcagaacatccaacagcctgcatggctaatatcgtggggtttgagaatatacacatttactatttcctgcgttatagaagaaacacaaccaaaggcaccattttatgcaaaaacatgagttttcattgcattccttgtgctggtgattaaagaagaggctctgataagcaatggctattctttaactcaggatgacagctccaggtgaaccaaaagaccacttggcccaattggtcgaaagtgtgttcttcagaacattacctcccatgagacattaatagttatttgaaggtgtggccaaataaatttgaaaaatacaggattaaataaagttaaacagattttttttctcatgggatatctcagagcctttaatatgataatgtcttatgaatttctaagaaaggaggagactgtactcagcatttcacaaaagatatgaataatggattttttttccagaatgttatgggacaaaattctaaatttacacatgggcaaagcaagaccccaagtagcataattcagttattattaaataactatttactacaagaatcatgttttttgtttgtttgcttttgcttttgtgtgtttgttttagttaatctctttggatcttgtactaacctacacaggtaggtactatgttatcatgttaaatgacagatgagaagagagactcagagaagtgaagtggtttgtcccaagttatggcattggtcagtgacagcaacactcaataccaggcacctctctataaaccatatacaacttccactttgccaactcctgtgagtatgattttatagaaagtataaaatgtggcagttgtccccaaagccatacgttgtacttagaattgtttttaaaatcatataaaaaagagaaacatggtataaaaaatgtggacaagaagtggcattgtacatccaaggtgagaggactgagtgagacctgggagaatcggggaaaacttcccaggggaagtgaattttagctatgctttgaaggatagaggaagcttagttagatcaaaggtcagcaacttttaaatatgaagtagctggtagtaaatattttctgccttgtgagccacacagtctctgttgcaagtgcttgacattgccatgtagtgtgaaaacagccatagataatatgtaaataaaaggacatggctgtgttccaataaaactttatctacaaaacagacagccagcccatgggtcctaacttgccaagccttaagtaagaaggaaaaaggtaggaaatgtggccttttttggctacaggaatcactttttaaaagatagtgagcagtatactcaaaggccagtgccaggccccagacctgctcataactgttccctttctgtctcccactccacccaaccccacttcaattgtgttctaagccctgagggtgagcttattgcagctatgcaaagagaaagctgcctgcatttgagataagctgaataaacagctcactgatcccagtggaaggtgcttgtgaacatgtgcctggatttagtctgttgggaaggcagagaaagacaacaaatctagtttcctcttgaaaaagagattggccttttctcctttcaataagtcaaggccaatggtaaaatgcttgcccgtttctaccgactgtgtgtggaccacctccccctttgcaggtagcaaagccaacgtgcagaagtcccagtttcatcagatgtatcagggcaacatctctgctattttatctgtagcacagaccccatgatgttattcctttgcacattaaacttcagtaaccctccaactggtacgggctcaaaatcaagtgcagcagcctggcattcaatgaaagacaatgtacagcagatttcaagttaagactctatccttactcccttcagcatccataccaactaacctacatttgtcttggtgtctcttgtccttgtgcatgattcacaagctacaaccttcagacttttgtacttgcaattagaacacccttctttcttcgtttcattcaagtcctaccttgtccttcaaggctctacttttaattccttttgcttggtgatgacacctgtatttacctctaaattaccacaacccagatactgcagtatcacttttattggcttacctctttttttcatagtaaaattatgtttttaataattataaaaatacaaacttactgattaaaaaactcaagtgttctggaatgtataattaaaaaaaaaagaaagaaaaattcagaaggatggtaaggtccaaaaagatgaacaaaggtaatatggcacagtctttcagggaatgcaactgctttggtgtggatgagtacaggatccctacagaggagtgatgagaagtgaggctggggagatggcaggatccagaccaccttaaattctctagcttccattgagtcttaatttatagatcattagagaaaaagcacatctttactaagcatctaggttgacacatagtcagcaatcaatgtatctttgttatattaatataaggtcttggggtcctaggctaagaaagcaccccaagtggatttcctaacattgttcatatagaaaaggcactgtctgagagagtctgcagtagaaagttcagggggtgctgactactgcagatagtcccaaaagcaagttccttaatcattttcccctcaaaatattgactgtgtgcctctccctgtatattggactgtacactaaagctaggcaggagaatgtgaacagattcattgcatagtgagctgataagggaaatgagaatacatgctggggagttatccagctaaagggcaactctctggcaatgtgctaaaaggagaaaagctcagggcactggtgatggggagaggaagagggaggaggaagctcatgagtggccctttgtcccaacactgaccttcccaacctgggaagcattttacaaagtagcagaattataagtttcaatgaacccaaaaggttattgagcgccccacccctctatttgcatttgggtgccatttggcctcactttgaactctcccttttacagggaattcatcctatatccaggaggccggtgtggagcagtggccagatgcagctgtggacaatgaaaagaggaaggaggactgatcagtcccctaagaagcagttactaatatgtcaggcactgactaggcatacgacctggtgtttcacatatctctcatgacaaccttgtgaatggggattaatatccctattatacatgcaagaaaactggggctcagggatattgagttatttgacctaattacaaatctggtaagcagtagctggaattcaaactcaggatgttctaccacccaagcccatagtattttagccaaaacaaagagcttcccatcaaaccaagaaaaggcaagatgatttaggtggcccccatgggaggccagggtaggaggggatgatcctacaggctggcactgccacagggagagcatgagaggatgctaggccgggacaggaatgcaggaagtgcttcaggacaggattacagcacactagcaagaacggccctgctggctcatgtgttgttggtactctgtgtgcctgtgcctgtgcctgccccacaatgaacgtttcgggcattctccccttcttacccccttcccaaatctcaaataaaagagggaaagagtacagctcagggtgtacagaagtgttctggcttgatcccataatcacacaaagcaagccccaccttggatcttttaccatctctcctttgaaaaccatcagaaagctcatcccacccttaccttgcttataaagcacttttatcctttcaacaatcatcatctcttccctgggccaggcactaggaataccaaaaacaacaccaacaataacagtaaacatttatagggttcttcctgtgtgccaggagctctgctaaggactttatgtgcattttcttacttaatcctaacaacaaccttgtgaatagatgctgtggttatttccattttacagatgaggaaactgaggctcagactaattcatccaaagtcacgcacagttggtgatggggctaggatctgaaatcagaatccaagtgcagaactacagtgactttcaaagaactaactcagaggccagtaaaatgggaagacacaagaatacatgttataggccaggcacggtggctcatgcctgtaacctcagcattttgggtagtcaaggtgactgaattgcttgagctcaagagttgcagaccagcctgggaaacatggaaaaaccccatctctataaaacaaaatacaaaaattagctgggtgtggtggcttgtgcctgttgtcccagctatgctggggggctgaggcaggatcacttgagcccgggggaggtcaaggctgcagtgagctgagatcatgccaccacactccagcatgggcaacagaatgaaactgtgtctcaaaaaaaaaagaaaaagaaaaagaaaaaagaatgtatgttatgatccagtgtgatgagcactgggtctatgaaaacagtgtctgagttgagttgaagagaacaaaaaaagggagaactaatcctgtgaaaagtacttagtttatgccaagtgctgaacaagtgatgttagttatctcatctaatttttcctttgaccctgtggagaagggattgatggtccctattttacagatgagcaacttgaagctagaagggatagaatcattgatttaaattatcaatccaataattagggggcttgtaggtgaatctcttctgataatctcaggttgaggtagaagggcatttcagcagagggatttaaacttgcagtgaccagagataagggtgggcagggcagagccaggggatgggagaggagatcattgggggatgcaagaaggggtaagattttggagaatgttataaaccacactaagaaacgggaaccttactctgaaggcaaaagataattatgaagggctttaggatcctttctctgactacagagtggaaagtgaaccagagaggtaataggggaagaatgaatggagacagggagactagttaagaaaacatttacaataacccagaagagcaatgatgaggacaggggctcaggctaaggggcagtgagcccagagacgacaggacaagtgtcagagatactgtgttgaattccatttgattgactgaaaaattgagtctcaggaaactaagtccccatcattgttaaaactaggacccaaactctgtttttctgattctgaggatcctttctggaactactcacgtccttttttctagaattctctctctcactcactcctgtaacaatgtgaatatctaccacgggctacacctcctgacaaatgttctaagaacatttttaattcttataataatcactagatattatgagaattataatcctcattttgaaattatgaaatcagaattccagaaatgcaaaaaaaaaatgtgtctacaaccatgtaaataggaagtagcagagtcaggatttgaacccaggccgtctggctccaacgtgtgtgtgtgtgtgtgtgtgtgtgtgtgtgtgtgtgtgtgtgtgtgtttctactgtacagtaccaatccctgaaacaacaccattgtttttcccccaaactctacctgtccgactccactttattttaaaaagctgcgtttttcaaatggaaaaaaaaaataccaactgaggaaacctaatatgtaatacattcttggataaagttattattgtccacagaattacagaaggctctgagcagcagaaaaacagcctggaaatttcatgctttaaaaacttccaaatatttttgtattattatttacttattttcttaggaagtaaattccgcacttagaggaagaggggtgggcaagaagtgtccacattcacaggtatttgttctcaagaagtgaggcacctgtgattctcaaaatagtagagtcgaaaggaaaaaaaaaaggtaaggcacctggaaaaaccacagcctccaagtattgatttgctactgtgggatgactacacccactaactcatttaggtgtctcaacatttgtaggagggtggtacttatatctctattttacaaatggggcaatcaatgcctggaaaggtgaagtgacttgcccagtgtcatccagatgaaaatgcaggaagatacgatccaaacacaggatctgtctggaagatgtgattcaaacactggatctgtctgtcataaagtgttttctgtttctgctgcaatctaccacaacctccttgatggttagcctagctcatatcttgctttctcatgaccgatgttatgagaaggtaacggatacaaccattatcagggtataatgtgagaagcagagcaaacaccacccctccgaagcctacaacattttctcttaccatcttgctgtcagaaattccactgtgagaaagtcatctttatgaaagagtgaaaggaacattatacttagtgtctggccctaagggctaacccttgctccagccaggcgcaatggtacatgcctgtagacccagcggcttgagaggctgaggtgggagaatcacttaagcccaggaatttgagaccagactgggcaatatagtgagaccccatctcaaagtaaataaataaatacataaaataaaataaccccggctctgctgtgccataggtgtgggactatgggcaaacaattccccctcactggccctaagtcacacctaagtcacattatctttttttttgaagagtcttgctctgtcacccaggctggagtgcagtggcgcgatctctgctcactgcaacctccgcctcctggattcaagcaattctcctgcctcggcctcctgagtagctgggattacaggcacgtgccaccacgcccggctaacttttgtatttttagtagagacgggatttcaccatgttgatcaggttggtctcaaactcctgacttcgtgatccacccaccttggcctcccaaagtgctgggattacaggcgtgagcccccgcacccggccagtcacattatctttaaagtaagaaagttagaagataactagaggcccttcgttgtttcacattttgggacattagcagctcagaggaaatacactggattagttctcagagcaaaggtgaacatatacagagcagaagaggcagaggtatggggcaggggagaggaaacaggaagacttgaaataaggagtaggtctctaatagaggggcaagaggtagcccaaggtgacagctctgcccccttgtccacaaccttgctgacaagattcatcccacatcaaggacccatggccctgggagaacattgatcaggggttattagaatctggggtgagaaaaggggagcagaagacagccagcaaaaaatcttccagttactctgaataccctgtgacaccaggctgtgttctaaacctgtgctttgctgcagggctgctaagctggtggcaagggatggccagccataattgcagaaccagcctagtcttcccgctctctttttctggctgccattttcacatgaaaaccataaaagatcccagaagtgggaggtgcacttaatgggtttttttggcaccaagaaattaatcttttttaaaccaaagggatttttttttctttcctaaagatctttggcaaacagaagctaaattgcttccagacctcatgaaaggtattttgtgcaaacgaggtgtgatttacacttcctttaattagtctgaaccctggaaaaagagagaaataatagaaaacaagagctatgtagaaaacaagtccaaacagccctaaaataacagttttgtgaaagcatcagttgagggtgttagaaggagaccaacaacaaaaaaaatccttctaattctgggagtggagcaattacaagtgaattgaagttttgttggactcttttccctggggatgggggtggggagaaagtttggcagaaatgagccttagtgttctcagagtgagtttcaagttctggttgaccttcctgccgttaagcttcagtcttttctgagggcatttggggtctaggaagccagagagtcagggaaacaaaaagacagtgctgcttgctatcatggatattttgccatcaagcttgtctcagctggatggcaacatggcattttggaaggggagtggcctctggaatcacagacctgggttcaaattttggctctgccatttaccaccaccatgacctggaaacttacatctccaatcagttgaccactaccttacttctttaaggcttctttccctggttacctggtgccccagttcccgtagtcattctatcatgttgctcctgcattgtcctcagtttcaagcccacttctccttttggtcagttggctttatcaagataatatatagacatgcattgtttcacctttaacccgacaaccccccaaattctattgcccagacggatattcttccttagttctggtcctcatatccaattgtcttgccactttgcactgacatattgcatgatctgagctaatcttgcctcatctctatgcaaaatgggaaagttgagtgagatggtctctgagcatatccttgctctgaccctttgtggcaactccactgtgatcatttttcttcattcattcatctcttcttaattagttcacttatagtctaccacaatctctggacccatccacacagcctaggtctaagagcccttgtaggagtttaagtttattcagacaatactggacacagcaagaacggctgcaggggtgaatcttatctttaactttaactaatcccatcctttctgactattctttccccagggaggtggaaggggagaaaaagaaacaaaaaactaccttttgggcaaaaggaatggaatggccaaggctacattatatacaagccaaaagaacaatttccattgaccttgaggaatgtgtaagggcaaagtcataagccgagtttaattgataatttcactgtccatatgtgaagaaagagcaatgaaccacaagacttgggctcaaggcccagctctgcctctaacatgctgcaggacctaggatcagtcctttcctgtctccaggactcaattttcttgctatacaatgaagggattgtacggagtgatctacatggactagcagctctaaggtttgtaagactgtattataaactttgaagagaatgagggaagggtccaaggattctcctttgcagctttcctagaaaaccatgtatcttccccatgaaaggaagaatacaaataatgatggtcaaatttactgaatgcctattatgtgccacatactaatgtccatagttaagagtcaaactaagacccaaagccaaaagaaagtattgtacccaaggccacataactagtaagtgatgtaactgagacttcagatatcaaactaactccaagcctgtgctgaacaccgttctcttcatctacccagccactttttgttgttattgtacctttgtttgtttattcttccattcactcatgctaccaatgttccctaagtactttctctgtgcacgaaactgtgtaaacaccagtaagcatgagaaaagatctatcaggaagttcacagttgagcaaaagaaacaagaaaccgtgatcaggaggtttagaaaagttatctttctttccaaagcaccattctgattatgtttacgatcctcaaaaggcttcaaaggttccccttttcctacaggataaagtccaagtagcttagcctgttttcttatccctctgagatctggtccctgtcttgtctcctctcgacatcattcattcaacatttgttaagtgctgactatgtgccagacactgtaccagagtcttggaatgcaatgctgagtggcacagacttaggccctgctctcctggagcttgcagatattaatcaaattatcacactgatacagaattaggcaatcctttaaacttccagtggtccagccccacttgattcaggatccttccttccagcagaggttcccagcccaggaagtacatagtcatgcagttctccttggactctttagataaccagttgatctttaataaagtgatttgtctaattaatcaaccaggaacatctgcttctgaagagagaacttttcttggatcccatgaataaatgtttattttattttaacatagtttttcaacaacaggttaaaattgctggctacacactactatggaatgccatgatctccctccagaggagtctctgcttaaagttaattgcttattacttatgttcccaatttaatcctaaatttcaagaaggcagagtttttgcctattcttgctcatcatcgaatacccagcactttgcccagtgctaggcacgctgttctgtacatgtgctggttaggcatccttaactacataaagccttaattcaaaatgagactgtggcagacatagatccttaccttaaaaaaaaaaaaaagttttcagaaggtgaaacagagcctgagaggaaaagcaactttccaaaagccacagagaaagttgatagcttaattgaagttggaaccaaagagaaccagaagtcctgaactcctgctataccacacccactcacacaccttgagtctgaaatggcaaggaggacaggtcctcaaagcaaaaaggtgcataactcgaggcagacagtctcccatcccaagcttctgttgtacatgaatttacatcagagagtcactgagccgactcttttagatgtagaagagaccatcttcatgggagaaactcttgcctgcccccaaacaagacctctgactgaggaatatattcaatcactccctctaacccaaactccccaaaacactatttcctattatgtctccataaccaaattcaacccacccaaatctcaagattagatctgtgagctcacaaaggcctaatcacccaattaagaggaggaaaacctgatcctttctaaacaaagtgaaatgtgaggtaacccagttgctgagattaagtctcactcaggaagaagcaaaggagctaggagagaatgggtgggtcattcattaaacggaattttccaggaaatttgagtgatgtgtctccccagatctcagtgttccaggccccagaacaatgctggaggcaaggccctggctttaggaggaccatgggggtgaagacagcattactctccttgcccgaaatccctaggtactatctggggcattctgatctctcactggacaaatggcctgctatcaatgatgaactttatactcaggcccaaaaaattccaagagaaaagtgcttagaaagataaactatagcccactaccatcatttcaatagactcagaaaattcaacatccatttcaaatggaaacaaaacaaagcttttgcagcaaactagaaatagaagatacctccttccatgtaataaagggcatataccataaaaaaatacaactagcattatacttaatggtgaaagactaaacgtctaaaattagaaaaaaggcaaagatgtctgttcttaccacttctgttcatatagtactaaaagtcctagctacagcaattagacaagtaataaataaataaaagtcatccaaattggaaaggaagaagtataattgtctctgtttgcagatgacatgatcatacatatagaacactttaggaagaactgagttttccaacactggaggcatgttaccagtgcatgttcaagggcatacaaaaatgttaaagagaaagcaagactagatgatctcttaagatccttccaactctgatacagaagaggtactccaagacaaagaatggagtatgccaaataaacggtagagagaatgagtgagtgcactatgttgagaaggaaaagactttgtgctgaaagggtcaagaagcctttgtggaagaagcaacacttgagtagttttgatctagactatggtctataagaacaagcactgtgctgggcataagactgacctggttttatatatatataaaaattatctggttcaggaattgaaagacagtttggcataccgttaagggcaaggactcagatagacctggattcaaatcccaattctgccttagacaagtgatttctcctgacagagcatcaattttctcctcttcaatatgagaataacaacttctagcttatagaattgctggaagaatttgtgaaaatgtatttgatgttcccagtagagtgcctgtcatacagatgtgtgcagtatgtaattggtagtgattactctgagaaggtgtttggactttggttaattacttactgatttctggaatgagacctttatgactgatacaaaaatggacacataaaccaatggaacagaatagagaactcagaaataaaaccatacacccaagccatctggtcttctacaaagttgacaaaagtaagaaatgaagaaaggactccttattcagtaaatggtgctgggatagctggctagccacatgcagaagaataaaactgggcccttacctttcaccatatacaaaaattaactcaagatggattaaagatttaaatttaagtcctccaactataagaatcctagaagaaaacctataaaacaccattctcaatgtcagccttgggaaagaatttatgattaagtcttcaaatgcagctgcaacaaaaacaaaaattgacagtgggatctaattaaagagctttcgcacagcaaaagaaattatcaataaacagacaacctacagaatgaaagaaaatattcaaactatgcatccaacagaagtctaatattcagactctgtaagaaacttaataagcaaaaaacaaataactccaataaaaaaatgggcaaaagacattaacagacacttctgaaaagaagacactcaagcagccaataaacatgaaaaactgctccacattactagtcatcagagaaacagaaatcaaaaccacaattgcgtgctatctcacactagtcagaatggctattatcaaaaagtcaaaaaacaacagatgctgatgaggctgtacagaaaggggaacacttattcactgttggtgagaatgtaaattggttaagccactgtggaaagtagtttggagatttctcaaagaacttagaattatcattcaacccagcaatcccattactgggtatatatccaaaagaaaataaatccttctacaaaaaagacatctatgtttctgtgttcattggagcactattcacaataacaaagacatggaatcaacctaggtgcccatcaacagtggactggataaagaaaatgtagtacatacacaccacagaatactacacagccttaaaaaagaatgaactcatgttctttgcagcatcatagatgcagctggaggcgattatcctaagcaaattaatgcaggaacaggaaactaaatatttgtgttctcacttataagtgggagcttaacattgagtacccatgggcataaagatagcaacaatagacactgggcactataggaagggggagggagggagagatccggctcaaaaactacctattgggtactatgctcactacctgggtgatggaatcattcatatcccaaacctcagcatcatgtagtagagctatgtaataaacctgaacatgtaccccttgaatccaaaaatctaaaataccagttgaaattcacacacacacacatacatacacacacacacacacacacacacacacacgtatgtatatataataatgagatcttaatgagatctttatggacaaaatcctgacagtgactttgagtttagagaggagccacgctctcaagttgaagattctgctaactcatcagcaactgctcatctacagaggccaccaattcccatctggagaaatctgctttcctaaaatcaacaattaaaaagcaacactgggccaagcgtggtggctctcgcctgtaatcccaacactttgggaggctgaggtgggcggatcacctgaggtcaggagtttgagactagcctggccaacatggtgaaaccacatctctactaaaaatacaaaaactagctgggtgtggtgacgcatgcctgtaatcccagctacttgggaggctgaggcaggagaattgcttgaacccaggaggaggaggttgtggtgagctaagatcacaccactgcactccagcctgggtgacagagcaagaccccatctcaaatttaaaaaaaaaaaaaaaaaaaagcacactgttatagaagatcagatctcaggcaatcttatgagagacccattctttgatgtggagggttaccaagaaggatcttggtatggactcagggttagacaacctatggtcacttctgctggtagtgagccatgtgatttattttaggctacccacactaccattctcaggttttagttttcccatttatatagtagggataatgatataagcttccaggacttgctgtgattactccaaatccttgtagagtaactggttgacagcaggagcaagaatccttagtggttacatcccaactgcacttcttactagttatatgtccttggttaagtcactgtccccttctgagcttctattgacatatctggaaaatgagtccaaggatacaccacattataggactgttgtaggcaactggatgagactatgtataaaatagtttataaagtagaatacattactgaaaggcaggagatgctcatattctatgcccaggccctttgagagaagcattccagtatctccttattattcttccagtcttaaagggattgtacttccatgtagagaagagtttgaaagccccatttcaatgtctgctctgtgaaaaggttaccagtattttttattgtcatttagagtgacctgaggggaaattggccagacttctctcctaggtctacagtgttactacaaaactgaaactccacccagaaacctgagccagctggagaatgaggcactgggcatgaaacatgccaaaaatatctacccgctgctttccaggatcccaaatgacactggtcattgaaaacccatccctctaacccaaagggaaaaattcagctctgcttaagaagaacttaatgcccaatattaatgttaaaatccaaaaaggtccttccaaaattctgaccttctattgaaagacatgtttttgtttcactgtctcttggaaaatactttagcagcacatttcagagttacaaaatggagcagattgacagacctgggaaccgatagtctgtttattcactgagcagtgacagtggggtcatagcaacagacaaaaggatgatcatgccagggcttctgaagcaaagatatctaagaacctgaagtcttaatgggtcctggggtgggaattaggataggctttgaaactatgatgagttaaaactggaaaccacttgatcttggatatgttacttaatctgtcataataatagtgtcttcatcaataaaatgggatgatacacttcctattatatagctttagaatattatgctggaacgctcaagaaatggtagttttttttctctgacacctattcacactgattttttaaaattgaagaatgccacttacatacagatcttaagtgcatagttcatacttcaacgtttttgaaaaatggctggattatccacttttatatgggtagctgacccacatcttagcaacacagacaaggtaaataaagaaaaagaggttatccctctgggatctaagaaatacagacctataaggaaacagacatgaactgatccaaaaaatttctctttttctttcagtgtaaattgaggtcaagaattgacttggggaggaagatttggagaaaggtcatataattctacagttacagaaataatcccaataattagcaaatacgtattcagtgtttaatatgtccaacaaggataactctccccactaaattatttatcatcaaacatttccaggggggtgtggtcacagggaaccttctggctgtagttcaacatactggttgcattaagaaaggtaggaggaatgaaagagagctgaaaggagaaatagattgcaattaaagatgtattacttttaaaagtgccaagcatattggacacatagttaacagaaattcattaaataattgctgaatgaatgaatgatcatgtagacaacttcaaaatggagtacaaacatttactttgatgaatcgctctcttggtctctcatgtgcagtgttgatatgtatagtgtccctctcagaactaacctttctccctttggattgtaaaagaattccaggagtttcttaatcaaggttcctaatgagttgtggagagagaagggagaaatgcaacaggtcttcgtttttttctgtgcctgtaattcctgccactgccacatgatgtcactattgaaaacaaagattctgcatggctctgtgtcaagtcatggtggaggcgaagggaatagaaaggagccttaaacagattacagtgtttctccagtagagggcaatcccactccctcagtgacaacaggctcaagcttagactcccaagcctccaactctttagttttatgtttcattcctcattctcaggtcatgcctactgtggcaaagtggctgtacatactgtggctttgagcctgtcataccaatcagacatcttcctccctcatgataagtccccctagatgttgggacaattttaacccactgtagagtttctacacttcacatgaagaagatcagaaccttccacccatttattcccaggagttcctagatttataatcaaattttcacagccactccacaggggcatctgggctatgcatactcactgaggtggtcattgaggggtagcctactaatggcagtggcagcccatatgaagcggccactgcaaagacaccggctgcagcaggggagatgcagcaggggctgagtgctccatggagctggcaggagctaggaacaggtagaagccccacccacttccaagttggaggagcgggagccccaccctccgaggcacagtgtggccacacagttgcagctgtggatccaggcattcctgcagtctcagggacctggggatcacccccttcccccacaggctcagaaatacctgctcccactgcctggcctctccccgcttcaagcagcccctccaatttcagatcaaagttgaggttgggcccaggcactgttgtgacctggctgggtgcatgtgagctcagggcagtgctgacatgccagccccctgttgccttggccctctcaagactttgggtgccaataagcacgggaaaggggctgggacagctctgcacaggccagcaggcacccctcagtatgaacaacctggtgccagggatggcaggttgacggcagcaggaggcagagagtttcctgtgtggaaaggggcaggtccccagtgcagccccaccttcaggcctgggatggcctgaaccctgggggctgggctgccagatctatggaccagagtgagaacttacagtgatttttccagacttgaccatggacacctatggacaaatcagtatacagttcctcctccctgaagcccataaaaactccggactcagccagactcagatagatgtcaggactatcagctgcaggattgagctacccaggaaggagctttggtctcctcgacttgcccatggaaagcagtgacccattgtaggtctcctctctgctgagagctagagagctggacactcatcaggatgacctgccttcagaaaggagctacccacttcaagtctcctgagggctgttctgtcactcaatgaagctcctctttgccgtgctcacccttcacttgtctgtgtaccttatttttcctggaagcaggacaagaactcgagacttgccaaatggcagggctgaaaaagctctaacacaaacagggttgaaagacaccccttgctcaccacattgcaggcaatgaggagagaagagctgcagcagttcagggagctcagacctaggagctccctgagccagggccatgacgccctctttggggctctggtatctccaagcttccagatgccaccatgttccctggtgccagccatggaagctgcttgtggtacatctggtccagctgtagcctcacagggagctggcacccatgccggaacctgaagccacctgcccttctgcagccagagtgcctgactatgtgcagtagctgcaccccacacccactagctcacacacccctcaccactccatggctggcttgcccttggcaggcatgggatccaggctggtagcataagccaagtgcagcctcaagctaatttgctacctctagatataaaaacatctatcagctttttaaatggcagctactcctaagaacaagagaaataataataactatgactctacccaacaatatgaatggatcctgtagtgtgataagcatgggaagctagaaaaaaacagaatgcatattggataacttttttaatgcataaagtttgaaaacaggcaaaagtaatctctttatggcattagaagtaaggatagtgttttaaccttcaggaagaggctataactgaatgggagcacaaagtgggctctgtgaagctggtaatttgtttcttgatttgggtactggttatatggctgtgttcacttcctaaaattacatccatatatgtacttatgatacgtgcatttttatgtgggaatgttatacttccatagaaatttcaaaaataaatgaagacattctgccacaaataaatgaaagaagagataatagtgcagctggccctcagtatctatggggaattggttccaggtacccccttggatatcaaaatttgcagtggctcaagtctcatatataaaatggcatagtatttgcatatagcctatgcacatcctcccttaaattttaaatcatctctagattacttataaaacctaatacaatgtctacaatcacttcattcatgtggatttaacatagtaccagtgtatcagtccattcttgcgttgctataaagaaataactgagaatggacaatttataaagaaaagaggtttaattggttcacagttccacagccatgaagcgtggctgaggaggcctcaggaaacttacaatcatgggcagaagatgaaggggaagcaggcacatcttacatggttggagcaggagggagagagaagggggaggtgctacacacttttaaacagccagatctcaggataactcactcagtatcacaagaacagccacaaaggggaaatgctcccccaaagatccaatcaccttccaccagccctcgcctccaacagtggggattacaattttacatgagatttgggtgaggacacagacccaaaccatatcaactgggcatacagcaaattcaagttttgctttttaaaactttgtggaaaatgttttcaagtattttccatttgagcttggttgcattcatgaatgcaaaactcacagatacagaggggtgactatatgcatttaatatccctaaaggctgaaagtcatacaaccttagagatagaaagctctcaaagatgactgaattcaaccacttcacttcacagatacagaaactgaggcccatagatgggaatctcaagatcacaaagggattcagcattagaagcaagtctcctacaacccattcatggatcttttcccttcataatgttgccttccttctcccagtgataaaggtgagatgtggatgaagtctaacaatgagctgtgcatcagaatgtcatggtctaaaatttttcaggcaatgattaacattaatatctgccttgcaaatggactcagcagctgggacaaggcagatgtggcaacacaaatatgttgcccatgacacatgaattggaagagtggggtggaggcagctcttgagtgaaggaacaaaagaaaagcctgtctgtctggaatgcaatgggaatgaagattccaaggaggtcatttagggagaagcagtgcctgaaccccagacaaggctgggtgcggtaacatctgtgcttttgcaagggaaataaaagggaatctgcttccctgcctgaagggatgatatatgggcttctgaggcactgggcgtgggccgaaggcatgatacagggcttgatggatgaaggctgaggtaactcagtaggccacacattaataaaaattatcaaactgtcccagttggtggagtagaatgctaatgccattctccacatgtatgttaaaggaagagaatgtctgaagggaggtaacctgctttttatctttaccttcatttcacttgtccaaattatatcctctgttctgctgccaagatcctatgcaagccaagtctggcagagcctactctatactacaaccacctgtgatagttcacctgcatctagccattcttaactgagaatgagaagtgtattctaatcacaacttagccccataaacaactttcatcactctcaagtgcccaaagaatcaacttcagatatcataacctagccttcaaggctttcatccgcttgaccatgaattccagtcttgctcattctatacttctccagacacctttcatttccatcttcatgattttcttgctttatgctcttccatctgtctgaatttcctcttacttgttctctattattgaaatcccttccatccttccaggttgagatgaaagcccactttattcacaaaggccgcacatccttagcctctgatttcagcctcaattgcaatggacagttccaatgtgagttcaaactcactttgcgctgccccaagacctacctccttgaatatatgccaggtatatctttgcacttcctgccccaaggccttcaatgatgccgtgggacctctctcagctcatatgagcaagtatagcctagaagtttaagaaacatcaatctttaaacaattgagatagggagctagagaagacataatctagctttgcatctttaagccagcaagagcctcaatacatcaatagtaatcttgtgaacacatccctgtactggctttttccccttctgggtcctgttcatgatccttcataactgtttcctatggatacctacctaatctgtgctcaagctctgttttagggttatcaaaacaaaaacagaatgagtacacatcttctaccttgaattacagctagacctgtctctggaatttccccagtaattagaactagtagtcaataattgtttgtcagctagaaataaattttaaaatacaagccactagtatcaactctacatgtggagaagaacctcacttataaactatataattatcaagactgtccacgtagctaatagtaggtgaggaacatcagaagagtccagtctcactgacattcgattttgcagtcactttatgttcagccagttaacagtactcattggatgtcatttccatcacctctgcttccctattttatgggcccagaactcctttgagaagctcagctgctgcagaacagccagatctgaccttcctaaggcatgattcatcatgcattgatgacagaacatctgcacccaatgtatgaaacatggtgactcgcagtgtctggctcaggatatgacctggctcagagcttaagtcttcccatgatttctgtcttgaaaatagctcctagcatggtccccataccctcagccaaaagcacatccccctcaagtttttttcattatactctcctctccttttattaaaataaataaatacataggtacatacatacatacacacatacatacataatttccccttcagggattccttggaagccatcaagagtagggataaagagcagaatttctgagtgagaaagaattaggttcaagttcaaacttaatacttctatgcccttaagtaagtgactatgccccctctaaacctgagttttcccacatgtgaaatgaagataatactaactaattttcagaacaattttgatgattatataggataacttggcatctaggtgttcaataaatgctgactatcttctctttccctttaatagctttacacttcccacaatgcttacaaaatttctggtatggtgtaggtacttaacaaatgtcattactcttgcttcattcttgttgttgctgttgttgttgttgagacggagtctcactctgttgcccaggctggagtgcagtggtgtgatctcggctcactacaacctccacctcccaattcaagagattctcctgcctcagcctcctgaatagctgggactacaggggcgcaccaccatgcctggctaatttttgaattttcagtagagacggggtttcactatgttggccaggctggttttgaactcctgacctcatggtccgcccacctcaacctcccaaagtgctgggattataggcgtgagccaccgcgcccggccactcttgcttcattcttgtttgggctccgtttacattagatacctttctgcttgtggtgtgactgtcttgtttcatgacatatgacaatagcataatttacatatttgatattagggatacagcatggaatgggacaagtaaggtcctaaggcatgattacacttagcttacgctcaagagcaagagaactcttatcactgttgggaatgtagaaaggcgaagccactatgaaaaacagtatgcaggttcctgaaaaaattaaaaatagaactgctagatgatccagcaatcccacttctggatttatatccaaaataattgaaatcaggatcttggaaagatatctgtacccccgtgctcactgcagcattatacacagtagccaagatagagaaataacccaagtgtgcatcgacaaataaatggatgaagaaaacatggtatatgcatacaatggattatcattcagccttaaaaaagaaggaaattctgccatttgaaatgacatgaatgaacctaaaggacgttatgctgagtataataagccagtcacagaagaacaaatactgcctaattccacttatatgagaggtatctaaaataggcaaagtcaaagaagctgagaatagagtgatggtttccaggtgctgggaatgcggaaacaaggaattggttttcaatggagtataaagtttctgttatgcaaaacgaatatgttctagaaatctgctgtaaaacatagcacctatagtgaatatggtattgtgtgctttaaaatgtgttaagaggctagatgtcatgttaagtgttcttaccaaacacacacatgtacacacacacacacataaatggacaaaataaaattattggaggcgatgggtatgtttgtatcttgcttgtggtgatgacatcatggatacacgcacatgtccaaagtcatcagtatctatatattaaatgtatgcaatttttatatatcaattatacctcaataaagctgtcttttaaagggcaggcaaatcaaaagtaaatgagcaaatatataaataaatgagataatttcaacaaatgctgaatgacataagggtagtaatactgagggatgtgatagaaaatgacagagaagaaacctgatatttaggtagtcaggaaaggctttctgtgcagatgaaaatgggattaagactcacgtgcttaatcccattaactcccataaaggagttaacaattccagttaagggaatcactagaggaaagggtggaaaattcaaagcagagggaggtagatgtgaagtaacaagcttggtgtgtctaacaatgagaaagtaggctagtgttgttactgctctcacgtgtcaagttagtcatcagcttcctaaaagtcaactcaagaagggaaagagtttgggttatattgttctcctctccaaatataaggggattatctctcaaggatggttatatttttaaaaaatgtattttcttgcctactagaatgtatggcttccatctttttctggcctttgaaattggtaccctttccagaggtaattctccccagaactcaggatcagggcagtgagtgaacccaaagccataggcattgtgatccaactctttgaaacttgaatggtcaatgctgaagatacaaaatattccatgacttttgatctattttttttttttttttttttttttggagataagagtttcactcttgtcgccaggctggagtgcagtggtgcgatcttggctcgcttcaatctccacctcccaggttcaagggattcccctgcttcagcctcccaagtagcgggccaccatgcccggctaattttttgtatttagtagagacgggctttcaccatgttgttcaggatggtcttgatctcctgacctcatgattagcccacctcggcctcccaaagtgctgggattataggcgtgaaccaccatgcctggccttgatctattaatacgtcccaggagctacagaattatattcatgaactttgaatgacttcagtcaagtcacttttcttctctaagtcttatttctcatctgtataatgtgagtgagaggtgaggggtgggtaggggatattgggtaggtggctacctgtgatctctacattgggtagagggctgtgttcactagagttccagattttctgtgattctaagaagcctttggaatcttggagtgagtattcccagggaactctgatgtgctgaaaagctctcctacatcgttgatgtcagctgtgcctgaggctttttaatgggtcaacagaccccaaaggtgagctggagacaaacctggcaattatagattaaagggcaattataacagggctcataattgttctcttacaatcttgccttcattgttggttaataaccaaattctctctttccagggaactccaccctcaccttttcccactggggtaggtgaggctggatcagaacagggtaattgagttctccctggggaggttggggtcatgtgagcacagctccttgatctcatctcagatggctccagggaagtacccaaaatctctcctttgggaggtaggacagaatgactcaggaaaagggaagttaaaaggaagtttatgaagtctgagaatggaattggtaaataaatccaagtctggatactcctgaaggcaggtggtatggggtaaaatactgggctgaaacccagaagaccccatgtatgtgtcggccataacttgccaggagactcaggggaagttccttcaccactgggattcagttgcttcatctgtgaaaagagggggttggcttaactgatctgtaagtatcttctagataggatatgaggttggtgcaaaattaattgtggtttttgccattgaaagtaaagtaatagcaaaatccacaattgcttttgaaccaaccacatatttttaggattctagatgcctgtgactgagtggactacttctgagtctcagtttttacttctgtaaagagacaataacaagagtaacttcatcatagaattattgtgagaattaaatgagcttaacatggcatctctactttattcattcagtgctctcatttaatgattactcattagacttctactttaaaccagactttatgctaggagaggatggataattcatacagttgaactaggtatcttagatgaaccttcacagaggtgaagataccttcacagagctaggagtcttgtggggcacacatgaacgtttaaaaatggaagctatttttatgaggcatttctgttattgaacagtcagataaaataccactgtctaaataatggcgaatggcaggggaaaatattccaaggcatggtgacattctcaagagaagctatcctctgtccctggtctaaattaaagatgacacattcaaataccttcagagcaaagcagataatagaagttaatgtagtgggttggatgtcagaaaatctaaaagaggggattaagacgacctagagtttccatgcattctctaaagtggaaagctgctagtcaactctcctgcctactgctgtcacgtgagggtgtgagtctaaagttgccagaactcactattttccagcagaagccaggaatccagattttcacataaaaagcatccagatttcaagtgatagccacttattcaaatatttaaaaacattatgtagccactggtttgctatctctaagttaaagccaatatttcagataagcgagagtattgtaactgtgttcattttcaaaaggaaggtaaggagaaagtaaaggggatgaatgattattggctatcatctacatgccccaggcatcttacagacaacatatatcatttcatctgttgctcacaacaattctgagaagcacctgcgtttagttctgatatttttccctgaggcaattcacatatggaaaatgtgttttgagaaacactggtatggacagatatgactggcagcataaggaagattgaatataggggcaagataagaggcaggacagcctggtgaggaagtcatagtggaaatacacaaggtgcccctagtggggagaaaaacaaggacagatttgagacaaaatgaagtaattaacctatatttttcaaagttcatcaataatgtctgagaggggaattttacctcccttccacctccccatgtcagatggaggaggaagggactttacaactgtaccccttttcttattttctctcttcaccctcaggctatctatttaatggctgtgttcagaccaaggtcagccatccgtctaagtggacaacagaaactaaaccctagtcctatagcctggatctcctagtccacaccttgatgccacacagaataatttctcagagcaatgaacttctatattaaagattactctggtcaggcatggtggctaatgcctgtaatcgcagtactttgggaggtcaaggtgggtggatcacttgagtccaggagtttgggaccagcctgggcaacatgacaaaagcccatctctacaaaaaaatacaaaagctagccaagagtggtgatgcatgcttgtagtcccagctacttgggaggctgaggtggaaggactgactgagcccgggagatagaggctacagcgaggtgtgattgggcccctgcactccagcctgggcaacagaatgagaccctgtctcaaaaaaaaaaaaaaaaaaaaaaaagaaagaaagaaagaaagaaaaagaaaaagactactcagccattcttcctgatcccctgatccatgggcttcttgcctctggctgtcattacactggcagtgagcaatagagaaatgtagattaaatggtcagaagatgtaaattcaattcttgactccacacttataagaagtttgaccttcaactatcaacttcacaagacttatcctcaactccctcatctgtagatgtagataatattgtcctcttacttggaaggactaatttgtagataaaataagataatggatttgaaggtccttcaatccatacttcatagagcagccagggtgataaaacttttactctttaccatgacttaaatcactctctataatttcatccctcctatagtcccttctttttaaattccatactcagaatttaaactccagccccactgtccttttattccttaaggccactgtgcgtgctgtttcctctacctgaaccgctttccatcccacccgcccctcaatcttcacttcatttcactactgcctgttcacacttcaggtatttattgagtgcttactatgtgcctggcaatgtactaggcactggggatagggtgattaaaaaaaagataaatataacaacactttggagaagctaatattttagtgagaaaggcaaatgctacattcctgccttcaccaaccaaaatatattgagaattgtaataagtgctaccaagctaggaatagtatagaatgctaaaagttcatgtagtcaacaagagggccaaatctaatctaaggattcagataagtgacatttaaactgagacctcattgtacagacccaagtgggaaagaaaatctgtagcatcaatagtagagagaagaagtaggtaagtgcaattattcaaaccttgtacgatgtgtcaaaaagttttcatctggaagttagaagagttatgaaagttcttaaaaggtttaaattagaagaatcatagttataaataagatacctattcatcaaatatttattgagtgcccatggtatgccagctactgtgccagatatgatcaaatgtatattttaacaggtaactctggctttagagttgagaattgaaagggagggaaaagtggctaatgtgaggactatttaaaagatgatcacagaagatgttgagtggcttagattaggcaacggaaataaaaagaaaggacccgatttgagagataatggggatcaaagcaaaatagcttggttataaattgaacatgaaggtgaacaagagaaaagagttaaagataactgctttaagaaacttaagtttatagaggcaccagctatatagagtaaatgaacaattggaaaggagcaaacttgtagggagatgatagcaaatccagttttgaatgtgttgagtttgaattgcttgtgagatatcgaattacagatgcttatagtcagttgaatataattagggggttccgaagaatgaggtggagacccaaatgtaaaagcaatgactacattgattgttatgattggactagatgtggtaacccagagagagattaaattgagaaaagattatacaggaccaagccataaggagcttcaagataaagaacagataaagggaccctgcaagagaggctaagttggtgttagagagttagataccaaaccaggaaggtatagtactgaagaaaccaaggacagcaaatgtttcagaccctgtagaatgcatagagatatgaagtaagtttatgacccaaaaatgtcactggatttaatgacatagagttcacaaatgttcatggagaaaaatgttttagtaacttggtggtagcagaagacagaggggagtaagctgaggaatgaaaagatgaagtgaaccattgtaggctatactttcaaaggtgtgtttataaagaaaaggaaagagatcattttgatgctggaagatgcaatgttttgtttgtgtctttgttctaagaagaaaaatttataagcatataaatgatgtaaataatctactagagaaggagagatataaaatataggatataaggagagagattatatgtagattcctaataatttaggaaggcataagaaatactgcaatgaaaagattaactttagaaagaaaggaggacatctcctatattatatcaggaggaaatggggagagtatgcatgaaaaatgttaaattgtttggagaaaaattatactactccatcattgttcttaatgaataaagggaaaatagggtattatgggtttaagaatgatgaaggctgagtgtggtggctcacatttgtaatcccagcactttgggaggccaaggcaggcagattacttgagctcaggagttcgagaccagcctgggcaacatgatgaatccctgtctctaccaaaaatacaaaaaatgagctgggcatggtggcatgcatctacagtcccagctactcagaaggctgaggcagaaagattgcttgagccagggaggcagaggttacagtaagccgagatcacaccagtgcactccagcctgggtgacagagcgagacctccatctcaaagaatgatgaagaagaatgtaagttgacaggagaaacctagtaaaattgaatggaagcatgaagagtccagttaacactgatgactgatgatactttgatgacaatattcaaaactgtgtttttctgtagctgcgtgactgtaccatcacagaagatggagagttgcatgcatccagtgcaggtgtttgaccaagcagggaaattaaaagaccaaaaggcaagggagatcgagaggctgatacaagcagtgattgaaatatgaaccatggactctaccatagatagaaaagttggaactgatagatggagaaaaaggaatgctaccaagcaagagaaagtcctaatgagttaaaaggcacggctggagtgggagatctataaactgacagtataaaagatcatggtcaaagagtgggatgttagaactgatggctttttatggaacaatatcatgtgaggacaaagtctacagtgtggcccaggagtgggtggctgaggcagaatggagaaatggtcactggagatgagcagatcaaagaagtgagagactggattgttggacagaaaatccacaaaaaccctgaccttacctattgtgatggcaagaacccagatgaagagaaagctgcaaaccaggaacttaaaatacttaaagaaccagtttcagttgaggcaagaggatgaaggttggattcagcttgacttccccttttggggaataacaatgtcatagacacaaggtagtatagatttagtctgggcaaactctctggatgaaaggtaggtaccaacctagcataattcttgcctggcctggaaggagattctggtgagtgaagagagaaatacagattttcttctcttggcgtctctaacgggaagctgctactaaggacaagaatggcaacagatggtgacagggagggagaaagatcagcttgggagtgatctccaggcgaggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttgg

SEQ ID NO: 1957 - DNA, 262040 bp, Homo sapiens; identical to SEQ ID NO: 1952

SEQ ID NO: 1958 - DNA, 14000 bp, Homo sapiens
gggtgctcaacggcgcgtgcgcagagggaggcaggcgggtgggctgccggcggtggactcgtcggagccgcgggcggtcaggtagggggcgggaaggagggttggggactggggaccgcggccggagtcgtgggccgtggctcagcggccaggcgggggaacgtgccggcgtgcagcggccgcgcccgaatggcagggtgtggggaccggatctggggggggcaggactagggtgggggtggggctgcgaggggcaggctcgggagggattcgtggggctgaggagatccgaggagatgcagctgggggaggggagcgaggggctctgaagagatttgcggttgcagcatctcgggaggtatgaggtaatgtcggggccctgaggaggaacggggtgtagcatgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtgaggaattggggcgttgaactgaggtgcggggctgagtgtggcagagatttggaaatagggattaaacgatctgagtccgagggatttggggcatatgagtgaggaattgacgagggttgcaatatacagccccaaagattggaatttggaattgtaagagggttggggacagggtttggagaggattgaatcgtggggtggagatgtcctaactgggctataaaatcaaaggaccctgagtagatttgtggattggtgtcttgggctgctaaagagattttccttaaatcgctgcatgggagacagagggagttcaggggacccaaggacctaaaagtaatgtatgaaactggatgagtatatgaagatgagcagagttcaggtgctgaggaacaaagtgataaatcttcagttcagataatcctgaaggagtgtggtaatccctgtgaagggcagaatcttcttcatttattaaacaaagatccgttatcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccctgggttcaagtcctagctctatctcttcctgactttaagtcctagctctatctcttcctgactttgtggccttgaatgagttacttaaccacccagtgccttggctcttcatctgtaaaatggggttatgataacaagaccaatgtcacagaattgttgtgaggatttagtgaagtaaactagcatgcctaggatctggcacatagtaagttctcaaaatctagtaatttttagtcttgtatctacttctttactcagttttcatgacagtccttctaagtaggctctactgtattcagttttacacatgaggaaactaaggcttaggaagtgacttgcctaagtttccatagctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatgtgcattatcttagtgaattcaatcctgctaacagtctaggttttattccttgtttacagataagaaaaataacaggttaaatgacttacccagggctacagagcaagtagctaggttgggatacaaacccagttctgtcttacacctatgttacattatagtagttttattagaagccttttccaacccttcagagcccctatgtttatgtctggagaatagttggaagccagaagtttataaggcccttaaagtagatcattgtctatgcacactgatgtgtaacctttgtgacattccctccatcttgtctttctggtaaaacaatcaaatttaaaaatcatttctaggtgcccttaccaacctctcagccagactttgtctaaagctagggaactatgaaacatcctttaagttagtaattttatggctgggagttgatactgggatttgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaaccctattattcatttagcctgcccttgacatagtttagctatgtttaacttagtaatttagctaaagttttctttctctacaaacatacttccttctggatcgttttgtttgccccagactggtacaacttcaggagcatgcctgtgtttccctataagcccctacttgttgagtttatcttagttgtctgcaggtgccttaaatgccctgagtaatctaaacttcatcagaatcctctcccacacacaggagtggatgtcaggtgatgacctcactgaattcgttaaagtcagtcctgctaacgagtggcctttggtggcacagtgatagttttgcacttgattagcattctgttagaatgcatgaggaataaagtttagaaagctgacataaaaggaaatgagataaaccttgcaaaaaacccagtcaaaccaggggagcgtgtcaatagtaggatggacctttatgtcttgtgaaaggaaatgcaatattttacatgttgtctagtttttaggggaaagcactgtttatgtctggtttttgctcaaaattgtatcaccagtaccgttcacagggccagacacatagtaggtgcttagtaaagatttgttttgttaattgcttaaagttctccagttttgctcatggcctaagccaccaaaggctgatataggtaaaggaaatggagatatctagagaaccaccccatggtggcaattcaagcattaggtgaagatttgaaaccttagatcatctctaatctttagattctgggatcaggtaaaacaatttctaggagggcttagaatttttattatttaggtttatgtatctggggccttgggtacagtctgctgaaaagtgcctattcatttcttctaataggttgggtggtggcagcagcagttgctgctactgctaataataataaaaactattatttatgtatagttaattgcatgcctggcttggtactgtacttagtgctttacacacataatctcatttaatctttgcaataactttgtgaggaagatactattttaaagtccctttccatagataaactgagaactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggctttttccaggtttgagactatttccgtgcctcatgctttagtgaggggaacacaggttttcctggcaaagcatggcagctttggggcaggaattcttgacatcctcagagagcttggtgaagctgtagtcagctgagataatttggggatgtgggcatagtaaattcatttttttaaacctgatgtcttagacagagaggtaggaagcttttcaattgaaggagggatatgatattccagaaagcttgggaaataatttgctgctatttttacaagttggcagccttgtttaataaactgatctgcactgccagctctgggaagaacacagatgtccctgtgcattgtaaggtaacgttctagattcaaactccaaatgtcctcagtctgttgtcccagatgatagaagagagaactgtagctattgatttagaattgagaagggttgcatggatcctgagttgtaatttctcttttttttttttttttttttgagatggagtctcgctctgtcacccagtctggagtgcagtggcgcgtctcggctcactgcaagctccgcctcccaggttcatgccattgtcctgcctcagcctcccgagtagctgggactacaggcgcctgccaccacgcccagctaatttttttttttttttttgtatttttagtagagacggagtttcaccgtcttagccaggatggtctcgatctcctgacctcatgattcgcccacctcagcctcccaaagtgctgggattacaggcatgagccaccacgcctggccctgagttgtaatttctatcagtatgtctatgctattgcccctagacacttggcatttaagaatttaccattcatagtttcagatatccacatcagacctcatacgctcatgatatatggtaaatattattttgctgaggtatggatttgagtcataatgggttgcaagcttgctgtgtgagagtaggtcactcagctaataaatcaatctatcccactctatagcagcagaatctcataactatattagtgttccttctgtgttatggagaaaatgcgtatgctataaggcagcattccccagagcgtggtcaagggaacattagttaatcattgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtatacgttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcatatttatcttgttacttagcccttataataaccatataaggcagacaccattattacttctattttacagatgagtgatggggaaagagcttttggaagtttgagttaattccttatggtcatgcagctaagtaagtgtctgagactacagaatctgaattatttcccactatgcagtgttttgtctggtttgtttccctatctgtcaccctcacgtgacatataatagacctcaataaaatagttgttaagtaagggaatgactgaatgactggtcatagctattctctaaatgtttcttgagtgaatttatttatatagtcagaggaaaatgaataatggtttctttttctctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactag

SEQ ID NO: 1959 - DNA, 14000 bp, Homo sapiens; identical to SEQ ID NO: 1958

SEQ ID NO: 1960 - DNA, 22216 bp, Homo sapiens
ataagttactttaaggctttatttgttaagttactgcatagagttgcaaaagcatcgacaacatatttcctcaaaatgtagagtttacaagttttctgagctccctgaagtttgcaatctattccagtctcagtgtcctctaattttacatcaatcttctaatgatctagattgcccattgcatgcagctatcttttcatgtttgatttggttaaaggaaaatcagctttacattgtgaaaatgcatattgttagcgaattgtgaaattgtgaggaattgggctgtaattactgaatattggctctccatgaacatgttgctaaaatgtgggaagatgtgccagagaaattgtctctctcctcagtagtccatcgttacagcaacaattgtggaaatcagatgagatgtggaaccatttttgattgccttaaatggcgcatttgtatatgccagcaagaatctatgcttctatgtaaattgaaaaagggaaatgaaacagtctgtggatgtggactctctcaggttgaacgtaggtggatcagcttgtactcaacatctgttcaggctggaaatgcagaggaagtttaatatgtttactcaatcatactggtttcctgggtgccaaggcagaaaatctaaaacatatgacttctgttcacactatgtgggagctatttagaacaaaggtgatgatcctggaagaaaatgtggagacgctatctcgggtaccagcacagttggacttctttgctgccagcaatcaacagcccttaaacatcaacatttcaaggttttgtcgaccagtgtaccaagtaacctctaaaaacatttgagaagaaatagaaaataacactagattatttcttaacatatcaaaagattatcaacatatggccttggatgcttttcattccccatccttatatgtccatacaaaattataatacatttaatgtagcattccaatccagatagtagtttgtggagttaaatttcaaactccctttttgaaaatttccttgcattcataaacacgttagctatccaggacagcgtgttgctctaggaacaaaagtggggacttacaaagaaggcaaattataagaaatatatttctgtcaaaattttatgaaacaaggaaaatcataaaataaaaattaatattagaagaaagtcttatcaaattctatataatgatttttcatcaatatacttggcctctaattagttaaaaggaagatcatgcaaagcccagagtttttatcttgtggttactattcaatttaaattctcatattccccaaaatgtccttgttttagttggtaagacagcaagacagtagctacaattcagtggaattaagtactttgccatattccatgaaatacacaaggagaggtcagaagaaacacaattatttttgtctggcagaatacaaaaaggtgtcacagagttggcatttgaattggattttggaagatgaatggaaatgcactagctggagatgaaaagaacataatggactgaggaaagttcctttccaaaaatcaagaaagctgtaaaaggcacggggattttaataattatcttcagttggaattacatgtatgttgagtgcagggacaaaattgaaaaaatagttatgcctgaaaagttatatgggaaattattatcaaaggctattgatgtcaagctaagaagattacattttacctaaaacacctaggatctttaaagtggatgtaagactagttcctcttccccattcttatgttttccatattgtcctcctccttgtgaaaaattccaccaccgttgtcaacacttcactttatataccatactaatataatactttcacccatgagcagaatggatgagaacattctcagaaataaattaaaattactacatatattgtgtttgaaatggaaaaccatgaatagatacctttatagtaataaattaaatcttaacaggtgacttgcagagaacatggtaggtggtacaaaagtagcaaagtggggtggggaagtttgtaatttctaagcaattctctaaatatatttatttagtaatcatctagttctggtagagtgacttaactgagcgatgcatttcagaaacatggcttacagaaatcagatatttaggatagttataaataaaatacaacacaaagataaggcatcattatatatacacacaggagcttcataattacaattatatttgtaaaagtataatgtttaattatttaattgactaataaaattacaataaacaaaaatgactgactttaaagatatgacttgtataagcaggcttgtagttacctacttaatattacataaatttatttaacaagtaaatagacaaaagttacaatatgaattttaatatatatattatatatgtctatccactttgaaagtatgtgaatatgtttaacttaaataaataagaggataaagaaaaatcggtctatcagataaaaaaattaatgatagaaaaataagaaatccataaatgatattaaagcttcccttctctgttgttgcatgttatgaatggttctcatatttactgaagaactaaggtaaagtactggttttgtaagggtgggacatactgaccataaagcttaagattaaaatcaagtgtcatcctgcacaaggatgacacacaaatctgtgaagtgttgcatatttcttgcagtccccaaaaggacatttgactaattagctccaaggaaatggtgtgagtcaaagcaaaatgggtgacacccagtattgcacttgtgattttcatacacaaaatatttatgtaaggtgatctatgaaaagaggtgtggtaacacataggatcttgtgtgcaatatgttgttagtaggcctctcagaaatgagaacataccaacttgcatcttgtttgtggaacttacaaaaaataaaggtagagttttgtcttccacagcagctggaaatgaacatcgtgacttaagcatcattctaacaaagatttgttgattcaggtttaaggaggtagataaagagtagtagtagtccacgccagatgctgagatctgttagttttgtgcccttggtgtgattgatgaggtcagtaatagaggatgatcaggttatgcaatgtaatgaattaatatatttataaataaatttcattacaaattataaaatagcttagatgtcttgaattacaagccacaaagaatagaacatctaataaccaaaagtaggaattaataacagaaaactgcaacatttcaacattacaacctatgaagaaacacttttaagaaaaaataaatttattttttgtagagacagggtctccctgtgttgcccaggctggtcttgaacttctgggctcaagcgatcaccctgtctcagcatcctaaagtgcttgcatcacaggcatgagccactgcaccaggccaacacgttgggttttattgggaattttaaaatagtttcagcaataagattcaagaataaattatttcattgcttcaccatttctttgagcattttaaaaatgttatcttgttaaatctttgtaataacctagtgaaataagtctctaaaatcctcatttttagaagacattgaacctaagagaagcaacttgttcaagaaaaaatacctgttggtaactgcgctaggactttttatgagttagggacattttccattaagccaagctaactctagttaatttactgagtgatactgccctcaattcatgagtatttcatcttactttatttattatttaattagaagcttaataagttcatagagcttacaaacttaaagtctatgaaataagtaatgttctgatgttagctctgatattgtctgaaatactctaagaacttaataaatttggtaaatgttttctatatccgtgttaaaatagtaattttatttattacatttttatacatagcattcatcaacaacttttgaaacatatacgaaaattatctaaaaatcctcaaaataccaattcaggtaagacttcagatagcaaactactcttgatcgtgctaccataagattatggaagcgctgatcacaaaaaagcaattcaaaaagcaatgtgtaaatagcatgtgtttccatatatacgtatgtgggtgtgtgtatatatatgtatatatagctttaatttttttagtttattattcagaattagttaagaatttagttgtaggtagtttataatctcaaaaaaattatctgaaaaaatatttaattatggtccctaaaatcctatataatacctttgtgtatataagtaacacaatttttaagtttgtatattgtatgattcctcaagtgtcataacaactgagacttgttataaaatgtataaaccttggtgtgattgatgagctcagtaatgtgggatgatgaggttatccaatttaatgaattaatatatttataaatagatttgattacaaattaaaattagtttacatgccctgaattacaagccacaaagaattgaacatctaataacaaaaagtaggaattaataacagaaaactgtaacatttgaatattataacctgcgggggtctatcctgcagaccccggctgcatgacggatgagacacatacccagacagcgatattcagtgaaagagcagcaagggttccgagccgattacagacaccaaggttcttacaataaagtgagctggaggaaagaacctgttataaggaggaaaaaatatactcactatttattaagtggaagtcaattattatacatagaggtcttcattcttattgccttcatgttgagtagtctgataaggagaaggcagaggagagatttgtcttgctatcttgcagtggcaaaggaaaagaaaaatctattagtgggctcctagagtgaaaacccttattcaaggatcaactgtgtcacatagtgacttgtgtcactaaaaaagtaactatctttagaatttggaatttaataatacttttctggcaccataaacaaatgtcagcaagaattacaaaacttagccagggtgcatcagtaccaataggagaatatctttcaaagatacctactgagtgcagaagtcagaaaagcaattctttgttgagaagcgcaggttatgttacatagtcttgtaccaacaaggtctcactattatcaacttcattccgtctaagttgaaaccaaataagatatgtttactccattagagcaaggtatgttgttctatctactggataattagtgtgttaatagtaattttgttacagcaagatactctgtttctaatagccaaaatattatcattataaatattcagatagcttaactctaaactcaaaaaaattataaaaatattacaaaaacttttcacaacaatgaaaatgctactgatacctaaatgtgacacattgtacaatatgaactgtatgagcacatctttattatatatttaacaaaggacctctataagttaggtttggcaagttgcaggagacaaagatggaatacacagtttgggtctttaaggtgctcataatacagaagagctgtgcctattgaatttctgcatttttccaacagaatttccttaaaaagtttgttattcatttatccacttgtccacttaacaaataactgtcaggtatctttaaggtactaagcatcttccttgttattatcattgtcatttttatttgcttctttattaagatactaaacatttttcttgttattattatcttttttattatttattatttatttagtgtttactctgtgccggaaccccttttggagcttataattattacttattatgtcatgttgttaccatattcagcatgtgtcagaaattttatatccaaggtgaagaattaaagctttaaaatgtttggtagtgtccaggcacagtggctcactcctgtaatcctagcagtttgggaggccaaggcagatggattgcttgagctcaggagtttgagactagcctgactaacatggtgaaactcgtctctactaaatacgaaaaatcagccggttgatgtggcccgtgcctgtaatcacagctacttgggaggctgaggtaggagagttgcttgaggtaggagaatcgcttgaattgcattgagctgagatcgcgccactgcactctagcctgggtaacaaagcaagactccatcaaaaaaagaaaaagagaaaagagaaaagaaaagtttggtaatatttaaggaaagcatacagaataagtagaagtttgccaggtgaagaatcaggaggatgatatttaagcagaaagaaaatttaaccagattgtgtgtttggcagaaggaacatctacaggaacacctgacgaggctgcacccttggcaggaagaacacctgacacggctgaaagcttggtggaaaaaacacctgatgaggctgcacccttagtggagggaacatctgacaaaattcaatgtctggggaaagcaacatctggaaagtttgaacagtcagcagaagaatatgttaggccatgtgtctctataacagctattgaactctgcattgtacagtgaaagcagtcatagataatgtgtgagcaaataggcatgattgcactccaataaaactttgtataaaaaaccatttggtaagctgaatttggcctgtgatatatagtttcctggcccttcacacagaagatagatggagtgtaattacataaaaagttttaaagacaaagtaagcttttgtagtagttcatgctgtagtcttttttttttttgtcaccaatctgtggcctagtatcaatctattatgaaaatctgacccatccagggtaaaatgaatcaagttcagaagctcaatttacagatttaaacctgtaggtctttctttgccattattttattttgatttgtttaactgaattttttttaacttaaaaaataacaatagtatttggtagggtttctttttcatggtgaaagccatcagttaaggggccatgtctaagtaggaaatataaatataacataataataataataaaataataataaaaatggccttcagtttcatatattattggatatattttcctccagaattggcatttcagctgaagataatgtgtgcttcaaacttggaaataaataatgcatttaattatttgattaaagattgcacagtgaatttaatgaagacattatagtcttgtaatgtaatataaactcaatcttctactcacaaacaactttaagacagaatttaggaggaatgtcctttggaaaattatctttccttcccccacagatgaatcaaataaccaaacgtactgtttggaacatttcattttatctggaattaaccctctgttggcatgtcttcttcatcactgaaaatgtaagaaagcacagcctcatcatgaaaatgctgggtatccacgtctcacacaacttaaaaatcataatgagttgcaggttttattgtcaagaattaccctgtgcttcaaaaatgtgcttgctccttatgaagcaatataaaccttgtttttaatcttgcaaactgtatattctattggatatgtctattaaagatagagttatgagtgaacaataaatgtctttcctgagaaaggtgtattttctgttgcacttagacctgaaggtggtgtagaagatacttggccaaaactggggcaaagaggggttcctgtgaagaagcaacagtgagagtctggttatctacatataaaagaataaaactggacccttagactgtacacaaaaacaactcaaggtggattaaaggcctacgtgtaagacctgaaactataaaactcccagaagaaaacacagagaaaacaactccttgatatgggccttgacaatggttttttggctattggctatcacaccaaaagctcaggcaacaaaagcaaacaagtgagactgcatcaaactaaaaagcttctgcacagcaaacactcaacaaaatgaaaaggcagcctgcagaatgggagagaatatttacaaaccatatatcagataggggttgatatgtgaaatgaaaatctcacacaactcagtcaaaaaacaatccgactgataaatggccaaagtatctgaatagacattatttaaaaaagacatacgaagggcaacaagtatatgaaaaggtgttcaacatcattaatcagaaaaatgttaatcaaaacaactatatcacttcgcaactgttaggatggttattatataaaaaagagataagtgtgatgagggtgtggaaaaaggaaactcatgttcactgttggtgggaaagtaaactgatacagccattttgggaaatggtatgaaggttcctcaaaaatttaaaatggagctactgtatgactccacaatcctcctgctgggtatatacccaaaggaactgaaatcagtatatgaaagctatatctgtattcccatgtttattgcggtataaataaccaatagccaagctatgaaaacaattggataaagaaattatgatatatagttataacatattatatatcatattataatcttatatactctgtaataatataaatattatgaatatagtattcaatcttagaaaaattaaaattgccatttttgatgatatggatgaacctggatggcattatgctaagtgaaataaaccagacatggaaagaaaaatacttcatgatctcacttatatgtgctatctaaaaacaagccaagtatatagaaacagtagaatggtggccatcagggataaggattaagaggaaatgaaaaaaagcagatcaaagggtacaaactggcagtcatgtaggatgagtaagttgtacctaacgtatagtatgataccaatagttaataataatgtattctatactgaaaattttctaaaagcatattttcaggtgctcttgccaatcacataaaaatataactatgaaaggtgatggatatgttaattggcttgattatagtaataatttcatggcatatatgtatgccttaaatatgtacaataaataagtaaataaactaaaatgtaggttatcaaaacttaacaatttaaacattaaaactttcaaaacttgaaaaaatccaatgggagagatttacaattccttcaacactatcagagcagcaatgatggaagatatgtagaggaaggagacaacctgataaatgtagactcatcagcaaagcctgaggggacagtaattatatccatagtgttgacagccaaaccatcaaaaactttggtgtaaatatattatttttgcaacatatgaaacacaaacagaacagcaaatcttgattcaggcatctatcgtcctaattaactgcctctctgatcatgtgtgctctctgatcatgtgtgcatgtgtcaccttgatcgaaaccattttcaaaaataacgcaacaaaaataaactattgtaaattttaaaaatgaattatcacgtgaagtttatatttgaagttatttttcaagattatacttatcctgtggcctttaaattttttaaaaatttttcactctctagttgaatatttgctgtatgccaggaaaacttctggacactgaagatacttacagtcaacattacttcaaggcagttatggcatcctaattactgtttttagtaatataatatctgcttccaaatactcttagaaatgggcaacttgataaggtgattcctgaaagtctctgccatcttgattgtgttaactgtgtttatttaaagaggctaaaaatgagggtggtttttaatgcatggtaactattcattaaaaatgaaattatatatgaaaaatgaaattatatatgaaattataatgaaaaattcaagattactccatgccttctaacagtattatttctacttgggtactgttgacatcagaacaaattattgggataaataaatgtgtaagggccatacatacctactaaatctgagtgccatgaatttgtaattttatgttattttaattattgtagttattacagtatgtgtttataaccctttttgtgttaatatacagtaatcctagagacacctagaattattttaaaaggtgagtcagttgtcttcagttatagaaaattgacttatacacttttagtagcgaagtcaaaatatctgaactaagttcacttctgcacaaaggaaaactctgcgagtaactgaaattttctcaagattggcatatagacaatcctaaaaaatgtcctgggatatgaactatctcaaattggcagcatatactggcatgtgcctcatcctgctgacagtcatttcagtttgatacacttacaaaaaagagaaaaaagatagcttaataattccaagtttaaatagttatattggtatactccttaaaagaaaaatcagcacattatcttggagtaaaattttacttatgatttcttcacttttctcccatcaactcaacaggcagaaaataaaacatattaataaatacacatgcacacacacacacattgtggaaatcaaagacctgagtctatgtgtagcagtgtgttgataaactatctgtagagactggaggtcaaattaattgtatatatgaaaattatataactctagagactcaagaagacagataaaagttactacataagaaaatagagatttctctatttttccacaacagaaattaaagagtggaatagtgattttaaatacagcttctgttatcatttgagggaatagaaaagtgagggcaacagagatcggaatataggcactaatacttgaatgcctgttatgtgtagctattgtgctttgacaattttacataattgtcttatttaaccaacacaaaactttatgaaattgatgtttctaagactatttttctgtatgagaaaacccaggttctgacttgatgtcactcatgccatattgggtggctgaggcaggattcaaatgtaaacacggcagcaccacagtctatattttattaatcatacaaccactatatccacctaattataaagtctgtatgaaagcccagaaaaataggccagcattaaattgaaaaaagcattaaagagaaaactgttgatctaaaaacatttagttttacaacttttaatttaccaaaattgtggttgctactgtgactgttgtatagggaaaccatgcacaaattaattcatgacacattcatgttctttttgcatacgtctcttttaaaaaaaaagttatttaggtaaagtgctaaagagaagttatttcaccttgctgacattgtgtcttacagttttacccaaccaattttagtcattacttctttatcttaacaggattacttaattgcctagtcatggaatgaatgatttggctacttctatagatgcattaataaagccttatttgtataatagtcaagttaagatgaacatgcttgtgacctctcgcagaaataatgaagattctgcaatttaaagagcaataaaatgtaaagatgtaattaccaactcttcattatcttacggaatttcaagataaaatcactttatttcaatgtcaaaagacagagcattaaagtctttttcaaataccatttaattggatagattaagatactttaatatattaatttctttccttgttactgtatatttcacgataagaatgcagggatatatattagacttctgggaaattgaaactggtgtaacttaccagttaattctaaaatctattaatcatgtgctttgcttatctttcttccttggtaaaatatgaatgttcaaagatattttcatgttgtctaaagcatccgcatttcatatacaaatatatgaaatatataaaatattaacagaattataccaaatatatacaaaataaaaatatacaaaatattaatttagcagaaaaaaaaactgttgcatgaagataaggtacaggatggtactttatcttatggttttttgtgaaccatagtcagaaaaatcgggatcaaaaataataaaacaaaatatacccattgccttaaggaaataggtaaatgagataattatatttttaaaggaactatataaaagctttatgcaaaaatcacaaccatatttcttgttcctgcacatcccaatcaattcattagattgttttacacattctgcaaaaatattctaatgcaggcagagaatttgaaatgtaaaacattatcatactgtctcctatatttagagctcagctatgtctcttatatgttaaaatgctacttctgtttgacacacactcttacacctactgaggaaaaaaattgcttcatattaacaaagtgaattatctcttttgagtaacatgagtaacctggtcaatagttacttaccgtgtgttagttatgggctgaactgtgctcctctctcccaaaattcatatggtgaaattctaaagcctagtatttctgaaagtaaccatattgggatgttttaaataagaattcatttaaaatgaggccctcggggtgggtcctaatccaaaaaaatggtgtccatataaaataaaatttagaaaggggtaaaaatcagctacatgtatgcacagaagtacaactgtgtgaagatagagctgtgagaaggcaaccatctataagccaagaagagaggcctagaacagatccttccatcatggtcctcagaggagcactttgaccttggatttacagcctctagaactgtgggaaaataaatatcggttgtttaagccacccagtctgtgtgtgtgtgcatgtgtttaagtgccaccttagaaaactaatataattgacaaaagacataatggactttttaaagccagcacccaactacgttagcatcattttcagatgtttgttttagtttgtttattttattttatcaagtattataatgataattaaaaaaaaaaagttacatgaggtggttcacacttttaatcccagcactttgggaggcaaaggtgggaggatcacttgaggctggaagttcaagaccagccagagcaacataatgaaagccaatgtctacaaatttttttctttaataaaaaataaagctgggtgtttttataataatgtgttttattataaagcacacacctgtagttctagctacttgggagctgagttgggaggactgcttgagcccaggagatcaagactacagtgagccataattgcaccactgcactccaccctgggtgacagagtgagaccctgtctgtaaaaaataaataaataaataaaaatagataaaaacaatttcaaaacttaagactaaagaaactcagaaaactgtcaattacattttgctctgatttttctcttgtatatagtataatgaaatgttacatcaacttgccatttttaaaagtaaaaatcagatggatttagctgggcacaataccagttgtattgagaatttctaatgtcactcagatgaaagacttgaaggaaaggagatagatttagaaggaaaaggagacagacttagcaggagagatggttaatgagatcagtcattcaaataatctacctactagtaaagttagacaaacaaacaaacggcaacaacaacaacaaaaccctacccatcatctttagagaaaaatcatagtctcccacttgaaataacacattcgtctggaagcttaaataaaagaacacatattttcacacagcacaaaagaattatttttatatttggaacacgattgctacagaattatgaaaagaaaaaaatacagactgtagagaacaaaataagacaagcttccatcaagaaggaaacataaaatatactaacttgaaataacagatatacacaatatatggagttcaagtttttagtgttgactccagccgagatatatcggaggcaaagaaagatttgcaaaggattcatgaattatccaaagttaaacatgttatatctaaccaagccagacctagaacacattattggtcatattctttccattgactatgtctaattcctcttaaagttttttccctttacatataaatcctacacacattaccactttggtaagataaacagaacaaaacacttattttttctttcagcactttggatgtgctatcccattgtgttctgactaccattgtttctgatgaaaagtcaggtgttaatcataaagtcatttccttgtatggatgagttatttttcttttgctttcaagattaactcccttcacattttgtttaatccagaattattagaaactctaaatttgagactcaaagtcactcatcagatcaccacaaaatttcaaaacatacatacttagaatgtatattcttgtatatatcaatatataagaatatcaatatactactttaatgtcttcttttattaatacaaaatcattggaatatttgggaagggaatataagtcagagcaagagcatcctagattagtgattgctacatattaatcattcaatcattgtttttgtgtcaatgaaagaataaattacttccagtatttttgctgacatatttctttccctagtttcaagattcacagagaaatataccttaaataatatactttgattctcttgaaaacaattttctatctttctccccaatctttctcaatatttttaatacaatattttttgtttctatatccatcaaaaagtttcagtgtgatgagatagcataaaaatctatttagaggatcagtttggaagtcaagatgtgcaaaatgtttcttatctgctctgttctcttttcattatcttctccctgacccaaccccaaacattgtaaagaatgctaaaccctttataaagaattttaccagaatcgatattaaaattgagtgtgctatttattacttagaagtaattatcaaactttaacctgtaatctcatttatttacagtggagcatagtagttagaagaaacgtgactcaattagaggtcaattactccttagcaatgtatcagagttgggcaagttactcaacctctgctaataacaatctcttaatctgtaaaaataaatatatccatgaagtattcctaaggttaaatgaaataacttatattaaagtaaatcacttggtgtaattttgaatatacaatatgttctagcttgaattactactactaatgaaaaactgaagctcagatcaacaaaaaaatagtgccattctccaactttttctaggtagtttgctagaaataagagagcaaaatagattagggcccagtttctggatttaaggatcagaaatcatctgctgtgtttattatgaaccttttgtatcccttcagttcttcctgtaaatttttacaaagaacttactgaataaacagttaaaacacctcaaattaacaaaatcttctctactatatctccattatttcaaaaaagaaaagagaatcctttccccgttccttctttttgtcaggtttgtcaaatatcagatagttgtagatatgcagcattatttttgagggctctgttctgttccattggtctatatctctgttgtggtaccagtaccatgctgttttggttactgtagccttgtagtatagtttgaagtcaggtagcatgatgcctccagctttgttcatttggcttaggattgacttggcaatgtgggctcttttttggttccatatgaactttaaagtagttttttccaattctgtgaagagagtcattggtagcttgatggggatggcattgaatctataaattaccttgggcagtatggccattttcaccatattgattcttcctacccatgagcatggaatgttctttaatttgcttgtatcctcttttatttcattgagcagtggtttgtagttctccttgaagaggttcttcacatcccttgtaagttggattcctaggtattttattctctttgaagcaattgtgaatgggagttcactcatgatttggcactctgtttgtctgttattggtatataagagtgcttgtgatttttgcacattgattttgtatcctgagactttgctgaagttccttatcagcttaaggagatttagggctgagatgatggggttttctagatatacaatcatgtcatctgcaaacagggacaatttgacttcctcttttcctaattgaatgccctttattcccttttcctgtctgattgccctggccagaatttccaacactatgttgaataggagtggtgagagagggcatccttgtcttgtgccagttttcaaagggaatgcttccagtttttgtccattcagtatgatattggctatgagtttgtcatagatagctcttattattttgagatacgtcccatcaatacctaatttattgagagtttttagcatgaagcattgttgaagtttgtcaatggccttttctgcatctattgagataatcatgtggtttttgtcattggttctgtttatatactggattacgtttattgattttcgtatgttgaaccagccttgcatcccagggatgaagcccacttgatcatggaggataagtttttgatgtgttgctggattcggtttgccagtattttgttggggatttttgcatcaatgttcatcaaggatattggtctaaaattctctttttttttgttgtgtctctgccacgctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgaggaatttatccatttcttctagattttctagtttatttgctgacaaaaagaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattggcaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaaaacccatcaaaaagtgggtgaaggatatgaacagacacttctcaaaagaagacatttatgcaaccaaaaagcacgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactacttcaaccattgtggaagtcagtgtggcgattcctcagggatctagaactggaaataccatttaacccagccatcccattactgggtatatacccaaaggattataaatcatgctgctataaagacacatgcacacatatgtttattgtggcactattcacaatagcaaagatttggaaccaacccaaatgtccaccaatgatagactggattaagaaaatgtggcacatatacaccatggaatactatgcagccatacaaaatgatgaattcatgtcctttgtagggacatggatgaagctggaaaccatcattctcagcaagctatcgcaagcacaaaaaaaccaagcactgcatgttctcactcataggtgggaattgaacaatgagaacacatggacacaggaacgggaacatcacacactggggactattgtggggtgggtggaggggggagggatagcattaggagatatacctaatgctaaatgatgagttaatgggtgcagcacaccaacatggcacatgtatacatttgtaacaaacgtgcacgttgtgtacatgtaccctaaaacttaaagtacaataaaaaaaagaaacccccccaataaaaaacaagaaaataataataattttgtcaatgatagttaactatatgttagtcactaacactatggcagttaccttcaaattcatatttctaatatttccaatatcttcatatttatatatctaattcatatttgaacccagctctaatttaggaagttctcttttttcttttagaaattaaggcataaagtgtcacgtgacttgcacaagattgcaccactagtaaacttaaaaatatagtttacttgcctactgtctcaatgttttagtgatttattgatcatgcacaattatttttgaaaacagaaattcatttagcataccacatttcaagatccattggtagaagccactttattagcttaatcaacaaaaatgtctagaaaatttgagcttttattaactgataacatattagaagttacatatatatatatatacatatatatatatatatatatacatatatatatatataatgaaacaacccctataatctttataaaattatttgggagaggagggagcagatgaaacaaaaataagcttccagcacatccagccttaaacgttaagttaacttgctgtctgtcctgcttcctcataattgttcactaggtatggccccacaatcatttatatcctgtcacaagattatagttaaacttaactactcatagataacaacttgagcattgtaaaatgttaagttttctctttgaggtattctttcagatcctacataccagtgaaactactgacatcagctgctccgaagggctccaggagaagccgactcactaaagggcaaagtttctacatcctggtgatttaatcccccttaaccaaaccagtcagtgaccccaattttccagcccctggtcctctacaatcccttcaccccagccaagtactctctggaaagacagattcgagggtgctcgcatctcctcactcagctgccctgcaatcattaaactctttctctactgcaaactctgtttatcaatttatcagactgtgactgcacaacaggcatacaaacatgtgagtcctgtatcatttataaatatttaacttttatgtatatttaactgctataccataattgactagtttgtatgttaatattagtaggtaataataatatttatatttcctccataggtagcttctgggggcatttctgcctggtaaattttattctttaatgacaaatactaaagtaagtaactttaaaatattattgagaattttttttctattgatgggacactgaatttgtaggtggaaataaaaacctagctttttactaaacttaattttttatttaaacacaactcaaaatgtaaatataaaattaagaatttccaaaattaaacttagttttaggaactcacataagcaagtgtaatactgaagagcaaagaaactgtgctctataaaaaaaaattacaagtaattcttgaaatctaagggctaatttgtgaagtaaatttggaagctactttatgctgtagctccatcctagagaccgagagaactgcactaggaaaacctgttcaacctttttttaaccagaaattctttctttctccagaaatccttttcaggtaatgcctaatgatatctcattgaacatgtattagaaattgtagtttaatttttaattaaataattcagtgaaaatatattaattgtaaagataaattttaacacatatgggaatactagacttacggtggtcatcaacccaaaatgctacaaaattacatagaatggttagtttggcaaaaaataaatatcaccactagcaccaaaaacctaggtttcaaaaagaaataaaagaagcattccaaaatgttaaaaatttttcatttatctactttctaaatgttctttgaaacacttcttatgtcatcataattttgaagtttaaaagtaaagaaatagttattctagttaatatactaccttaaagttactctggctcacaaacagaacaaagcaaagcatgacttgacagcagtcgaattacgggaaattgaagctaaacgaaattggatacctcacctcatctaaactccttactttataagaaggaaaagcatcacaaaatgttgaggccatttaacttaaagtcatcaggtgagttagagataatttgagaccactgctttttttctctttgttactattctcttatgaagttttgcctgaaaacaggtctactaaaaatataagaatttgtaatgaagatgaacatatatcattgcctttctgcttaggattgttcaatattttcccattgataatatataaaatcctacctactttgacctcctctcccaccatttctttgctctctatctcctagaacttcattcttgactccaaagctgcaccctcctgcatcagtttcttttgtttgaaatcttcagctcttcataaatttcatccagcaaactcctatttatcctttaactccctattattttttcttacagtgccacattttccttcattagcacatatccaatttaaagttacatagtttgagtttttgcttgactttctgtttctgcactaaagcataagctccacaaaagcaagtatcatgtctgatttaacagggtatattctattcttttttttccacaaggcggtgcccggttcggtcccagacgcggccaccaaccgacgtaaagccggtgagccgctcggggaggagagaggatcggcgggcggcgggcggggaagggggcgcagacaggcaagggccggggaccgcgagggcaagggcacctgggagcccgcagaggggcggctgagggagaaacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccaccggggccccgaagcgaccacagccacaaactcaacgccagggccacatcgctcgtgattctcgtccatcctccgacccggtcccgctccgggagaccggcgcgcccccaccgtgggacgctttcccagggccaggcggcccgaccacgtgccacgcaaacgccgtcgtccgcaccggtcgcgactcggcaagggagcgggcggagagctgactcgcggcggaggggggtcactcgccggacggaacgctgcgcgcagccatcgctcgctgtcagccgcgtcccaacccgctaggacgctgggccctgccggcgggatcctccccttactcggaaaggggaggcgccggccacagtaggcgacgagccgcgctcggccaccaccgcggtggccggcggaaccctcgctctccccccgtcaccccgtcgagggggaagctgaggagggttcctctgcaagcgagtcgctactgcagcgctaccataacggagagagagacagaggcggcaggccgggggatcccgtaccccaaggcacacctcttggatcgctagagaaggctttctcaccgaggatgggtcacactccccacccgccagccgcccctcgtggggcccgaggggcccgcagaggcgctcagggaggcctggggaagggagggggcctgtggtaccaggaaaaacctgcgtgcggcaaccttgagcgttcgcggtcagggcggggaccggcaggtgcgagcgtgagcgcaactccacaagcccccgcctcccacccccccccccaccccgtccacccgcctcttttcttcagaggcaaagcacctccgagtaaacccacacacgaccggtcggaggcagaacggtagcccctcggcggccggccggcgcacgcgtcaccagcccaagccc

SEQ ID NO: 1961 - DNA, 94 bp, Homo sapiens
gcatggccgggccaccaggaaaacacggccgcgggatcccaccgccacagacacgagggcggtcccgcggcgccccgcctgggacgccggaagg

SEQ ID NO: 1962 - DNA, 1169818 bp, Homo sapiens
caacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgtgtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttggggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaacccgggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgtgtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggatctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttgggacctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacgagccctggcacaccagtgtgttggtacaaaatgtcatcacgcaccagcagccaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggggccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacagctgagcatcatcattccatgagtgttgctccctcacggtatagacataaccagaacgtcacaataacttactctacttagacttgccaaggcctccgggaacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccgatctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagaggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtgcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagtgcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagacacaaccaagtaatttgtagctcttgccaatttctgtgatgtaaatactcccgtcatgggcaatttgaatctgccaacctgagagtttcctaaaaacttaacaaggggctcttgctacctgatactaactggctccagcacaccatggacctggatcctgtttctagctcaccccctcactcgtggtatgaccttcagcaagcagcttgaatgttttcatctgtaaaatggaccaggttacttggaggttcaagtgagtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccgggttcacgccgttctcctgcctcagcctcctgagtagctggggctacaggcgcccgccacagcgcccggctaatttttttttttttgtatttttagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactggtgagtttaaggaactgacccaagatcacagaataataagtggtgagctgggatttgcacctgggtctgtgcgtgggcgagtccacctggggcccgtgtcttcactcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatggtctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctcgggattcatgcctcataaaatcatttgatctggtgggatctcatcttcttaatgtgtctgcccatcatctgttcctgggaggctttattagggcagtgtgtgcgtgtgtgcgtttgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccggggtcatttgtgttctttgtctccatgtccttgcttttgaccagggccaaacaacccacctgcactgcatggttcccccagcaagaacatcccagtgagaatggcccacagatgcctgggcgtgacccacctgcagcttcaaccatgcaggtaaatttgcctgctgctgtgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccacagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctgatagcagagaaagacaggaaacaagaaaaataaataaatatggtagttttgcgtagtgatagtgctatagaaaaacgttcaaatggggtagagtgatagacagtgttgttctgagcttgtccaccacaccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagccatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagagtagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtatgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattactcagcactgactgagtgctcaacacttttctaggcactgggaatacagaaatgagtaagacaggccaagtccctgctctggtgagcttatgtactggctgggagagagacaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgttctttttctctctctctttggtgggagagctggctttccattagttaaatgtgcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacattagctctctgtaaataaaccccaaacctgggaatcatatatcttaaccggctaagctttatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtagcctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaactttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattcagtgctcatcactctgcaaatcaaggccccccgaactcctcccacccctgccttctgcgtctccctctgtgctctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggaggctttatggaggcaaagctgaggggctgtacgtgtcttcataggtctccagtctgtaaaagcaaccacgctttgggctggggcagaagtcaggacttgaactggctctggctgggacccaggctcccaggtagccagctcccaggtgacaggagtccgctgggctccctctgattcttaaagcctttccaggtagcaacaggagatcacgcaaagccacgtaagtgtctgattcagtcctccctggtcagttttccagcatagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctcctaggatgccatatctcagagtacgggcttcgacggggcccttcacccagctccaggaccaactgggagcctgttaggactgcaaatcctgtcctctggacctagagaatgaaagcctctgggggcaggctcagaaatctgtgtttccagattccactgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattcgtaaggaatttagcaaagaaatgtgaagacgagattgctgagttagataaaaagtggttaatgttcatcatgcctaaacttttgggggttatctgttctattagataaaaagtatttgcatctctactggacaaaagttgaccacttaagtggtgacttcacaaagtctgggatcttcaagagcaaacaatgagatgaactaagagcatgctcctaaacaacttcaggttgtccctgactgataaccaaaggatgtgccatcaaccatttgggccttgtttgcaagctttgaataatttttctggtgctttaaacacattattgttagtattttgagacggagtctcgctctttcacccaggctgaagtgcagtggcgtgatctcggctcactgcaacctccatctccagagttcaagcgattctcgtgcctcagcctcccaagtagccaggattgcaggtgcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgcctggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacatgctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatagatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagctctatatcctggggttcctgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatccggtgaacctggcagcataggtatcctctaagtttggttgtaagcccagtggggcagggcagtaaacagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttccttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtactttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcgccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcgttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagtgtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgtgttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctcttaaatctgggttttccaatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttacagggagggacagggagaaatcaggtttcttccagcccagcttctggttggaatcactcaggcagagacacatgggcctgagagaggattccccttatgacataaagccgcaaaaattctcattagtcattgcaaaaacatctatttccggcctacactgcaccagccagtgggggaggtcctgagagatagagaaaggatgaattcttgcccttagagagtcacctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaaagagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaaacaatggtaagagggcacatccttgccttgctactgatcttatcaggaaagctagtttcctaccatgaagtgtgatgttagttgtaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtcccatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccgttgcttattagctgtatgaacttgggcaagatatttaatctctctgtgcctcagttttcacatctgtaaaattatgtcaaatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctattggaacctagtcccactattcctctctcccttcattcaacactgggtttagaatgcttgccagcagcattgtggaaattacctcaaaggtagaaacacgtaactcataagcacacatgaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggaacaaaaaataacgtaaaaccataaataacagaaaagaatatatactcaaacatgtataatccatatgcatgaacataactcccctattgggaatttctcataaagaatccccccaaaatataataccacgtccacaagaacccacccacaggccaggtactgtgcgaggcactggaatacaatgggggtaacatggactaggagactcatgaaaacgtcatgacaaacacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagaggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttatcaaaaaaaaaaaactattaagttcattgaagaagtcataaaaacaaaccaaacacccaccaccttctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgtttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggctcctttgtcacaggcggctagtggttctcatgtgcagatgtaggacatccccgccatcacagagggatttgctggacaccactgagtcaaataaatggtagtatgtccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggcttgttgggagaagaagggagctggtttggagtaaatccatccccaccactatcaggtcttgcccaggcataccctgcttttcctgaatgtcctgaatgttgttgtaggacaacaaatgcgctttataattattcataggacctctcactactaatctttgagtcgataacagcttctgctatagaagggggcagatcactgggcttaaatgtcaaatagcgcctgagaggcttaaacaaccaccagtatgtgtccctctgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccaggcccggctaattttgtatttttagtatagatgggtttctccatgttgttcaggctggtcttgaactcccgacctcagataatccacacgcctcggcctcccaaaatgctgggattacaggcatgagccaccatgcccagccaccgccactcattttacacagtcccctgtatgtctcctagtgactcccctagaaattcactgaccctagccagatcccatttgtcctgtctttgtcagatttatcattctttgtctaaaaagttcaaaagcatcttgctttggccgcttcttcagacatcactctcttgtgaagatcccttgtacctggaaaactattaagatccgtatgcttttttcctgttgatctggttgtctgattcgtgtccatttggtttctaggtccagccaaagagcccacataagaaccaaggtggggttgggggtgatctctggtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttttggctccacttctgcctttgtagctgtggaccacgaggcagtgactttgaaattcagtcttattctgcggaaatattacttactcgtccctacctcatagggtggtttttcgaagtcagtgagacaaggacagtgaagggttgaggcagtgctcagcacatagtaagcgctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgatttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgaatcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggactgcagagtgctctctagtgtctctaagtgcaagaaggctgtgatgtgtctgactgagaaaatgcatgtgttagataagctttgttccagcatgagttacagtgctgctggctgtgataaattttaagtaaggcatctttaaaccgaggcgcacgtaaaacaaggttatatattgactagttgactgaactgtgaccagaggctcacaggaacctaaccctgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttatatgtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccattgtaaagttgaaaaactgttgtctagtcattctaagtcagggaatatctgtgtataaatcgtgtaaaatcctcccagaacctttatgagagggtgtggactgtgattcttaagttaatggcatccctctctgcctataacgatctcacgtctgtttttttgccaaaaaatatagctgctggggaacctgttcagggaagttgggatgtgtttatccttaggtgtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgggtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgtgtcttcagaagttatctgatgccagcttattcacatcgcctcacctcctagcagctggagcaggaatgcagcagtagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgcgaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgacgtgagtgaggaaggcgaagcagtgcacccatgatgtttggtgcagtcttgaaagcgcagtcactatggagccgccccccgcctctccccttctgagccgccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcacgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttggggcatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcctgtacattttccctttaaaagataaagagaaaccattatgcagtttttattcctgacctgcctcaaggagcagatacggactggaaagcagcccctgttggataattgctgcttgtctcagagtttgagattctgccggggtttcttgagtcaccgagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacatgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccgaggcttctctgtatttcctatcatgggtaatagtaacaatatcaataacacaatgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatacaagtctgtgcagtgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttacgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacgattacacctataccttcaatatcaaagcagatcaatttttaaaacaaatttactaacctagtcttcagatacataggtttgtttttctcactaatcctttgtggtcactgaaagagcataggccaccccagtcttttgcccagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcgcacctgagaagtgccccctgctggccagcatcatttctctgtgtctcactacagaaggaggtctttgtttatgaattctgccctccccctcttgccctgagactatcacctgctttggaaagaatggcatcatttccagaatgcccctaggggcattagcttctcttctacactctctctcttgcttttcaatatggaagttaacaacgcagtctttgaagctgggccgattggatttcaaattctaactcagtaacttcccaactgtgagtttgagcaaggtatacctcttaaggctcagtgttttaatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaacgtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgacatgatcatgactcactgccacttctacctcctgggctcaaatcttccttctgcctcagcctcctgagcagctgggaccgcaggattgcgtgccaccatgtatggctaatttttataaagttttcttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctgttgtttgtgtttttcttcccatttaagaacgtacatttgaaggtgcagtcttgaaattcttgatatggatggcagacacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatcctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattaggcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacaatgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccagtccttgttaagttgctgagactatcatgcacaaaggtatttacacagttttgttttgggtttctttgttttttgttttgttttgttttgttttgtttttttcaacggagtctcactctgtcaccaggctagagtgcagtggcgcaagctcagctcgctgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgccacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttactaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgcccgaggaacgccagctcctttgcattcccaaactttgcaagcatgtgtcatcctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacatacctgggaacctggttgttatatccatggctggggagcagggtagcagggagcaagaactgtccaacataatctagtttacctatggactttcaaaggtttgcaaagatttacctcctactaaaatggcttgtgagcatggaaggcttaaacattagcagagcaggtagaaaaataacgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacagatgtggaacaagtttttaaagaaggaaccctatctcataagattgtcaggatcattaaacatcacgagtatgagcccacaggaaaccttcagtatatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctacatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatctggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactacttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagaggaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcagcaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgctcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcaatatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttctgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctaccccttcccaaggactatttatattgaggcaaccaaatgatcaaggaagaattcgtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatctaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagatgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagaaatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatactcttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactatggaagatgagtccattatttaatcactctggccttcggtttttcagctctaaaaatgagaatattcctttcctcaatgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaaattgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggagaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccctaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacccacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgacgcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagagatataacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctcccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcatttttagtatatgtggtaggcagcttctaagtgaccccggtgatcctcacttcctggtcttcacggcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacctctttattttaagcttcttagtttgtggcaagataactaacacatacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttaggtctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgccatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactgcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggctggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttcgatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttccacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttaggtcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttcttttttttttttttttttttttttgagacagagtctcactctgtcactggggctggagtgcagtggcgtgatctcgactcactgcaacctctgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcattgtgtgtgtgtgtgtgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaagtatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggcagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtgggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagactgcatgccacatttggcccgtgagccgtagtttgttcatccctagtttaagaagaaaaaacatcttcatactaataataatatacaatattctgttggcaaaagacattttgatacttgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacatggccacccttaatgcgtgtcataactctgccttccagcaagatttcctctccactaagaaccttttagaaatggtatttaagagaatgtgcataaaacaagtcttcatggtgattatgacatttctgctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagtttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcagaggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtgtctgtgtgtctttctatgtgtaaatgtccatccccagggattaagaagtctggatttgggttaaacttaatcatttctaagaatctcaggttttcagtcctgtcctagaatttcaaaaacagtcagagaaagcaactgtgagaagatcacagcttctcatcctgttttgagtctcaccctcctctttgccctcacaaaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctggaacccgcccccccccccccccccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggcccctgtcttgttcgtctcagtgctccccagggcccacatgcagtaccttgtacacagtgcaggcaccataaatacctgttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatacttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagttctggagaactcgtacccccaggatcagctctcaaccagggatgaatacagatggaggataaatttccccactcccttgcccctttggagatgtatttgacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattggtgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaataggataatgcatgaaccatgcttagcgtgagccataacacgcaaaagcaacataatcagtatttgttaattgtaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggagagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagccgtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaaccccgtctctactaaaactaaaaaaaaaaaaaacattagccaggtgtggtggtgggtgcctgtaatcccagctacttggaaggctaagaaaggagaattggttgaacccaggagacggaggttgcggtgagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtatcaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatacatgacagagtgaccatagcactcaggggtgcagagggtgtgtggattctgatgacagattgcctgtctgattttgcagaattagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcgggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaaaatatatatatatatatatatatataaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaagtatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctaataatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacactgagatccagagacattgaggggctctcttgggctcccccaccttgtccaggggaaagtcaggactgggatccagcgtatagtcacttgctacggctattcccattatgttttgctgctgctgaaacactggaacacattctaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcaatgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacgccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattcatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaactggaacatgctctccaggcaattctatacacactggtatctaagaaccactgcgctcagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatggcagggtggtcaagagtacggactcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaacaaacaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaaagacacaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccagtgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatcttgagaccagagctacgtgcgatgctgcctaagaaaagccgcaaaggattttatttgatttttgcacacaacaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatctgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccgtcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggttcgcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaaaagagcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaatttggccacatctgcaatgtctttaccacaaaagttaatatagatgagttctagggattaggatttggtacctttggggatcattattcagcctactgtagtaggggttcatcagttagtgggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggggtatttatctaccaactccccttctattattggttgagtccctcttctgacgagtcacaggtattcccagtaagcagcctctgtagggcacaggtgagtgatgatgggattcaccgctgacagctctgctgtagatttccccgggcaggtgacctctgaactgccacctgaagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttacaaaagaggtttaacagactcacagtgctggggaggcctggcaatcatggtggaaggtgaaaggcacatctcacatggcagcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatgggggaaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagtggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtctgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctacaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggataggtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacaatcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcagtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaactcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttcccatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagacaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactccgtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctgtgagagactggaaggcacccagatgatccaaggtgatggccaaacctacaaacaggggagccagggacaagagcagggatgattgaatctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtattctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctatgggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcatgtgatgctgtttgatagcattttacccacagtagaacttctttcaaaattggagtctaccctctcaagccctgctactgctttgtcaactggtttaggtactgttttaaatcttttgttgtcatttcaacaatgttcacagtatcttcccaaggaatagaatccatctcaagaaaccactttcttggctcatctataagaagcaactcctcatctgttcaagttttatcatgagatttcagcaattcagtcacatcttcaggctctatttctaattatagttgtctttcagtttccaccacatctgccgttacttcctctactgaagtcataaagccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttagacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctgtggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggccggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattacgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctattatttatgtatggtgaaatctatataatggggaacagctgctcatagctgccagcacttcattcagtgaagtcacattggcagcttgaagctggccatgccgggagtatttatatgacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacatattctttaaacatctgaaaagtattttgggattcagcaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttgatctgcagcttaaatgtgacttcttcaaaaaagacttctttgatcccttcagtaccaaatgagttcttccctttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctgtcactcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctcttattcttgctcaagaaatgagtggccagttgctaccagcctatcccaaaagccaagagataaaagccagcagcagttaattttctagtccgtgtgctagtgaccacagatatctaaccactgatttccaaaggcttactattattcatacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctccagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgccttgatggcacttacttcttagggaaaagagaggatgacagaactgtagagaaaacagagtataccagatagcaatgagggctgtggagaaaataaggtgggaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgtagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggtctgtccctgcagtgactgtgctattcatagcaagaatgttgtgttgctaaacttggcatgaaacaatacagttatttatgcgacttcatgaactagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatagaatctaatgggctttgcttacaatgtgcatggcttggctatttacatgagattgacagcacgagaaaaaccagacgctatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacacaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctatgccttctccatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacgtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttgactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacctacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacctgaaatctctctcattctcacccattcacctttcaaatctgtgcttttagcacatcacctttctgccctaaaacgtttagtggctcacaagctagtttccaaattccttagcttagtagttagccctccgctaccttttcttaatgcacttttacacttttctccatgctgtaactaaacagcactacctactaaaatagaaagatacctttcaggttcctgacctcatgccagtatctaccatttccttttcctagaattctctctttctccttatttaaatcctgtgcattctctagtgcatttgggggaaaatgtcatctctttctgtaggcattaactctctatgccctaaaatttcatataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccctttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatccctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaacaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccacggcacctggctaatttttgcatttttttgtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgcttgtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagataggatggcagcctctgccagcatgtttcaggatatacccaggaagcaaatacctggttggaataacaaagtccaaagcgaagcaagagggtgattgttaaatgagtaattagaataaacactgaaaaatggtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctctgggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatatgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggcgcctgtaaccccagctactcaggaggctgaggcaggagaatcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagaactaagattaccaagtcactaatatttttgtggttcttaatggatatatattgccaactgcttttcaaaactattgttatatttaataccatcaaaatatatccattcacaagtttaattacactgtcttcatcattagtcataacgttttaaaaacataattgccagcataagagggaatctatctatgtctttctatttctctctctctatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaaacctgagatgcttttatcattgaaagtagaaggtgtccccattactggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgatttcttaaaatttttacttgaaaaaaatttcagcttataaagaagttgcaagagtcgtaccatagttggaaatactctgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagcatacctgggacctggttagaaattcataatctgtagccaaaacctatggaattggaatctacaattagaagaccctcaggagtatgcacgttaaagtttgaggtgtttaaagttaaagtatgcactttaaagtttgaggtgtgtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcctcaggtccgaatcagaaactttggagaatggcactactgtttaacgagaccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattccagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcagcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggttgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagagctggggtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccggtctcagcgattgatctagacacatttatgaccaatatatggcaaatgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgcagagagaaagagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgagtaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcctgagcatctatccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagcccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaaaacaggtaaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaactaatagtggatttctccggactgttaacttctgttcaaagagcccgccaatgatggatagagagcggcgtgcagaaaggaatctttccctggttcagcttgggtgcactgccttgtgctgactctgtcccctcccctacccaccacaccccatgtgtctagaacaatctcctctgcagtacttcatttcctaaatgaattagtccagagccctgttttgaacagatgcctgtacagttcttgattggttgaggcaagtctaaactgacataagccctaactctgaaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcgttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctcttccccttaacccctaactgggggctttctaccctgtctttgcacaccatttatcctctctataatgacaactcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggccctttattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaacttagtgtacagtaactctaatgcctgatatttgatttgcattaagcactgacaagaacctttcatgtctatttctgccctggggtcctaaaacataaattttaacattccttgcttctccttgatgatcattcccacatagaaatggaactgcattaataatgattgttgaaaaaatgaataaatgattgttgaatgaataaccgaatgaatgccaccagggaaaattattgtctccatttcattttagggcctgaactttaggagaataaagttatcctaaagagagctgttggaacctgcctttctaaccagcttcctattttctagaaaaggggtcactgtttgtaggaattgtctaggattcctgagaactgccatcaaacattcattttgcttttcctattgctaagcattatcagacagagacacagcttctacacaaaggaagatggtagggcattgtctgttcagggctgctagatcaatattatagttttatttatctattaatttatttggatttctaagcagctctaccttttgttacgatgattatatggcaaaatgcaaaacaacttgacaggactttgctatctagacttttgataatgatctctaaaagccaactcatttcatttgcgtccttttatgaataatacaaaaaaatccaaaccttaactagtgtttgtcacagtcagtgggtacttcatgagccaagagtgcatagaaaggtatttttggttcattactaggtttctataattgacctgacattttgtgagagcaatcatgtttgttaaggagaaactcaagccaatgctgtagttgcaaagttctccttactattaccctgggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacatttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaaccatattttgtcaaattggttatttctgatgatgtatccccaattttctgaaatgttttaaaacttacattgtagctttctctcatttccttattcctatgttctcattctggtccatcatctgttcatttattcagtccattctttgtgtattcattcaattattctttcaagtgacatttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaatgtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggaaagaagtcatgagtcattagtctggactgctatagtaatgataataatagtaagaataataatagccaccatttgtggatcacttactgcaaaccaggaactgtgttaaatccttctcatgtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctcttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcctatctactctcctgtttgtctcttgctgcagactcctctaaggcagggaccacttttcaccacctttccatgcccctggatccttgttcagatttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttcatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccccctttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttcccctgttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgcaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttttttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttttgaattgtcatgcagctcagaactgggggatctagaaactgaattcagcagctgattatttggttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcaggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtagtttatggatgtgtcagaacaaactgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctattatgcatctggtgtaaagcctcctcatctttagctcaattcaacaagtttccattcagtgcccagctctaaaagtcttaaatggaaattgattccctactccttctattttaactgtcaaaatcatagactgcattgtttccaactgaaaatccgctgacagctccccaccaaccaccccgtgagccttcctagggctggcgttgatgatgctgctatcaatggggaatctacattgtgcacgggtatttatgatgagaaaatcatgtggcataaaagagaataattgccttcataagtgtataattttttatactataagcttctcaatgaaaaagcattctaagggaggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtaagttcttggatattggtttcttcttataatgacttgagaattacatggaattatccccattatatgagaagacagagtctcacaggagttaaatcacttctcataaaatcatctctcatagttatgtgagttcagaatgcacgtctatgctaccccaaagtccaagcttaatagagaaatctacagcaactctttatattctggagaggttttattactaagcttaagaattgaggtgccctaagaacgggctgcccccaaaatattttcctcaccacctcacttctgtttccagaagcccaacatgaaaatcactcttctgaaataagtcctggagtcttctttaggcttctgctaaaaagtcttattcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattgaatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttggaacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctcggtgcaaaatatgagatgtcctttgactatataatataaaatatactataacatataatattgaccttatattgaagatgtatttgtacccgacatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgttgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacctgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatagggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctctgtctttatggaggccacgttgaacctctaattctggagaatggtaacattgaagaggacattagtggccattgacgtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtgacaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtccccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacgtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttggagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctcccgagtagctgggactaaaagcgcacactgccatgcccggctaatgttttgtattttagtagagatggggtttcaccacattgcccaggctggtcttgaactactaagctctgagctcaggcaatccccccgcttcggcctcccaaagtgctaggattacagccgtgagccaacacacctggcccaatagttccaattttttatgtgtatatttttaaaaaattaagttgtgactttagcgtgaattgaaatttgtttgactatacttcataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtaccattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgcttccccagaagaaggtcctgggatgagaatttgtgttaaagtgatgtatcggaaaggttgctaggaaaaacgtatagggaagtgggaactgagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccatggaaattggccaacattacaaattagggctcccttccctccacccagaagtgttcagtaaatatttactggcatactaccggagctgctggcctttgggaatggaagcatactgggggtccgtgtgcactaaaatggcaaagaaaatctaggggatgtggatggtgcagggacagcatctactgcagcactcatgtataccagctgcaatatggtaggaaacctgcccctgcccacacaggctaggcagaggtgtgtgagaaaaagggaactggtgagagggaggggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactctaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcgcacgagagcccagaatcagtagctgggcctcctggtgtggaaaggatagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgtggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttctttttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcatttttttttttttttcatttctacatggcttggtttccccatctgtaaattgtggatacttacactagctatctcataggttattgtgagaaataagtgagtctgtatgtatgaagcccatagaaatatacataacatagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcttacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagaggttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggacatatccttttcctattctgaaactctactctgcttaggatgcatactgatggctctttttttgtgaatggatggaagtatgaaaggagcagtaagaaagggcactatcaggctgcatgcagtggctcacatctggaatcccagcactttggaaagctgaggccagcagatcacttgaggccaggagttcaagaccagtctggccaatgtggcaaaacactctctctcctaaaaatacaaaaattagctgaggacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgcctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtgtttcatttgtgataattttaaatacaagtgttggtctgaagaaaggaaatgatcaggaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgtagggaagttgagggacatgtccaagatcacacagatagtaggcagtccagcttcagaatctgtggtctctaccagtgcactttgccacttcacagaactatccagccagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggagcgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatagtctcattgcagagacttctgctcccttgttgcttgtaggaatgggggtggggaaaggtcaggactatatatttaagaaaaaaaccccacatatgtcgacccacaagtggttacaacaacattggtttacttgaaagctctgtctccactctccctacaaaaattcaagtaagaacctggaatgcaaggaggtggaagagttttctctccttgccaatctctcccttgctctctgataaaaggtgcggcaaacagggtagaaatgactgcacgggaccagaggatgtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgcctaccgttctgcttgctggtggttcaggttttgtgaacttatacaagggcttggtatttgaatgctatcttaatgagaataagcttttttgttgtgtacattggcaacttgatggctaaggtcattctccatccatttgtctagctacccacacacctatacatccatctacccatctgtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagctgatgaatattcagacttgaagttcctcctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaaattgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgatctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacccggagaaaatggtgattagaatctctgcaccagtttctgtgatttttttgagacatcctgaagatgagaggtgagtagacagcagatgggcagggccagcatggtttttgtctggttatttatttctgtggaataagttcctagaaataggatgtctctctgggtcaaaaggtatgtacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctggcttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccaatggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggctcaggatctgacatctttgggacccattatcagtctactaactatgttattaaatatagcttgcaaatatgttgtcgaggattttgtttttatattcctgagagatattggtctttttttctttagatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggtgatctgtgtcttctctcttttatcttggttagtttaggtaagatttgtcaattttgttgacattttcaaagagcaaatttttggtcttattgattttctctgatgcatttgtaccttttttgtgtacttcaaagaagccattggcaaattaaatatgactggacaacttttcacataagtaactaggaaaggtaaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccttgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacttgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagtgagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaaaaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttctgcactgccgcttgttacttggagccattacttcctatctgtgttgtcaatcgtgtcttgaggttattctagcaccttacgaaaagccaccatccacctaattttagagcttttaagataaagcccgggagcactaggaaggtgagtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattgctagctctcgcaccctctctgcccttgacctcaataatataccatatcttgattcactggctccaggtctcctaccaccgaggacttgccttactttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagatctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggtacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccacgtggctgcttgggcttcctcacaggatggtaggtggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtattgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggatactatcatccttactcaatatctgccaatcctttgggcaacatagaatattctactgttgttttcatttgcatttctcttaagaccttatctggagaattatgttttttcaacataaataaataagaattgtccaaggtaagagttgtgtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaactgaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttactctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgggcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttcttgaagtaactttatggtttgtatacggatgccaaatatagatacatatctaatttatctattttatttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttcgacttgtggctttgtcatttccccacaggggcagcttccgctggttttacaggacagaaaagttctgtttctattactgaagaggttgaaccctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtttagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccacatggtcccacctacaacatgtgggaattatgggagctacaattcaagatgagatttgggtgaggacacagccaaaccatatcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttgaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgattctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcatgggctggcagcgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagacggagctgccatcttgaacatgtctagtccttagttcctgccagcattcacctgtgcaagtctccagcttgcttgtctatgtctgcagctcaactttacattttctttgttagaaaattatttggggttgctttttattaaaaagaaaagccttaccaaggattcccatgcccttaccatctgcctgtgtaatttcttcttaactcctgtatcatcaggaacgtgaaccctattgtgaattgtacatgccagggatctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtggtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaaacaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcaatctttaaatgaagctattttttctttgtctctctgtccctctgtgtctctctctgtgtctcacacacatacacatgcacacacacacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagtcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaaggtgaagaggagcaaaatcgtgtctcatgtggcagcagacaggagagaatgagaaccaaatgaaaggggtttccccttataaaaccatcagatttcatgagacttattcactaccatgagaacagtatgggggaaagtgcccccatgattcaattatttcccaccaggtccctcccacaacgtgtgggaattattaattcaagatgagatttgggttggggacgcagccaaaccatatcagtaggtcaaatgcaaagcctgaaatatggagaggaagacatcagtataaatcctggttccgtcacttgaatacgttgccttgagcaaattattcccttgcagaatctcagtttttccacctgtaaaatggagacggcaaaaattaacagtcacctcggggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacaacaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaattttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctctaagatcagcttctgcttatttcgttgttttgcttcatcatctttacattgcacaatccacgtgtagaaaatagcccttccctttcctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgctgccgcaaaatgtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagcggatgtgccatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtcaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaacctaagcatccaatagtgaaagtttatatgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgatgcaatatctgtggataaaaccaccagcccctatcaagtcaatcaaatatttactgagcacttattatgtccaagacactttggagaacaaagaaatataacctggccttgcccttcaggctgtatcaattgagatagaatttggactgctgcaatcaattacacagatgtctctcaaggtagtgtcttgatgcttgagggaaacaagacaaaatgctattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatagccctttatcagctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttggttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgttaacatcctacaatatacaggactgcctatcatagcagaattatctggcccaaaatttcagcagtaccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctcttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggcgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagcttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcagttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgctgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaaatatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattcggcctcaccttttttaggttctggcagccccaggtgttccttggcttgtagctgaatcactgcaatctctgctttgttcctcacacagtgttctccctgcgtctctgtcttcacatggcattttcttatatggaccccacgcatactggaataggtccactctaacggcttcctcttaactcgatgacatgtgcacagattctattcccaaataaggtcacttttgcagattccaggggttaggagttggacgtttcttttagggggacacaattcaacccctaaatggggatctcctgacagttcttaatagggtcaatatttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggcgaggacagtgaaacccacagcagtgagagagttgtatgcacatggacacaaaagagcatctgatcataaagagaaggaaaccaaacctgtctgggcactgcaatgtgtgaatctagaactctccaactgctatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacgtgactccttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatagtccctggttaatagtaagctttcaatgagtgttggctagcattcatgcccgtaagttatcctcttgcctagagcagtgatggctctaatgtgagttcagatccctacaataggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctctttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcaccagtgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttgactgaaatgatattagctctgcatggtgaacttagtaatttaattctgatcagcagctctggttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctgcatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagctgctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacaagaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaactttagaatattttttaaatctcctggaaaaaaaaaaaaacactatcctgagtcatacctcattttccaccattatatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcctaaaacattcaagaaggatgttatcggtacatgatcagagttgagtaggttctggattttaatgcctgtacttgctttttacttataaatgattaatactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacagatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataaagagacaaagaatgccttaggtgtttcctctacctagcataatcaaatactactatgaaatatgcaagagtctgtgtcatcactgacattcagtcttggatttattttttttaactctgtgtactagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcctgcaaccttttattcctaattctagtctttaatatctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagctgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaatagaagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatatctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccaaggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagtaaatttccccttttatttggaaagcctctactttacaattcatgtttaccttcctgaatcttttctacatttcaaattcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagcaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgagaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttattttttaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaatatgcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacgtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatgcatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtgggacttcccaccacaagtcaatgaggagatggggtagccaggcctaaaaccccggcctttggcttacagccgcccgtcattttcccaggtgcccacctcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcaattgaacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacaacctccaccacaaagaattatctggccccaaacatcgatagtgccaaggtggagaaaccctaggcttatggatgccatgggaaacaccagttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagcgtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaaggtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatcactgagatctcataaatccataatgggcctgctctgtattaataaaacaatctcaatggtggagctccataaaagagaggcataggctgatgtaatttccttgaagtcccctgtaaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcagtctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttaatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctaagtgattactctgtatgtgttagtgaaatgcattaagtgcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacagtgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccaacttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattcaagtatcctagcacgtcaacttttattgcttcacttaaaatctgccaccttccaccttcatgtcctgaatcctttatctagaaaatgtgtaattttccaagaaggcctcagacctagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaaccctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattctttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagtgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtgctccacctatatcctttccttttaccattctggggcatactggcctaatttacttgcagaagaacaaacacattctgagaacagccaggcctcaaccaaagaccagcaggagcaggtgcataaataccccaactccctcacccttcgaatgcgatgactctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccattattgctgggccctgccataagcttatttgtatttcacagcgacttgcacagatgtgccagatatgtacagatggatttttatcagaagagagtctacccaagtgaagcagtgtagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgattcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaaacagtgtgcaagaatcctgttaaagacctgccctcactgaactgtgcccctccacctggaggctgcagcgggtcaaggatggcttcactgaagggatgatatttgaacaagacttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcccaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttggcttatatttgcccagaaatggaatttctggatcacaggtatgacaggcagaataatgaccccaatgatatccacattctaatacctagaaactgcaaatatgtgaccttgggtggcaaaagggactttgcagatgtaattagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcgctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttgacaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgtagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagcagtgcagaagggaaatatggggttggagcccccacacagagtccccactggggcactgcttagtggagctgtgagaagagggtcaccatcctccataccccaaaatggtagctccaccgacagcttgcaccaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcgtctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggactgcatacatacaaatacccattctaggtggtttccaaaaggactccatttctatgggaatattttccattgagctgtttatgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagccctctccttgaccccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccatatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccatttcccagtatttattgagggatgaagagtctttctgtcaactttcagtgagaagaagtaaataaaacagctttgatggatacccccatgaaccggagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctatggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttcgtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcaggggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaaatattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaaaaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgagttaagtctatggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcattgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcagtttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagaatgaagactgaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattctagaattcagcattttcaaagttcatctttgaaatggatagcctcttgttctgcagaaaagcaaggatcctagaaaaaacatgcaaactgcatttcaaggaggatggcatcatctttttgtttctcttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttactgctgaaaggcaaatttaaggtaaaaatcaaatactttaaaagtatatatcttaatatgccttcctcttaacattcatctagtaaggggggagatgtagaattttgatataaattggccagccttatgttgatttatctttaacacagatttcaactccttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccattaaatggagattttgatatatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatgtttgtatgatcaataaattggtctgatttaaaattagcctataaagacattttttaaaagcaaatgcttaacttcaatactacatgacaagagggtgatatacaaaaaaaagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggatatcttagaaaatcataatgagagtgatgatgatgatgatggtagtgatgatgattatggtaatgataactatagtgatggtgatgacgatggtgatggtgggggtaatggtgatggtgatggtggtgatgatgatagtgatggtgatggtggtgatagtaatgattacggtggtggtgatgatgattctagtgatggtgatgctgatggcggtgatggtgatgttgattattatggtaatgataattacgatggtgttgttgatgatggtggtggtggtggtaatgatgatggtgatggtggtgatgatgatgatagtgatggtgatggtgatgatggtgatggtggtgatgatgatgatgatgatagtgatggtgatggtggtgatggtaatgacggtggtgatgatggtgatggtagtggtggtgatgctgatggtggtgatggtggtgatgatggtgatgatggtgatgatagtgatggtgatgatggtggtgatgttgatggtagtgatgatgataatgatggtaatgggtggtaaagatgataatgccttactctaggctagatattgtgctaaatatttcactgacaagcaaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttctataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctgggctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggtcaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactccttaatgttactagcatttaagttgtttttttcccccctcctttgtcagtcccaaagctcctatggctcaactgttggtgcacataaccttagggaggtgatttgaagaaattttaccgaaatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcaggttatatttgtccttttcctcaattgttcctacctacctaccgacttacttggctattttcattcatcattaagtgattgatggatcatagttgctaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacgtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcatttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccactgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccaggctgggcaacaagagcaaaactctgtctcaaaaaaaaaaaaaaaaaaaaaaaaaaacaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcggggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtggaacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttcagctcatggaaagggctgaataaatattaaatataaaccagacctcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctattttactctcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttcctttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactcctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggagacaactcttagagcccaaatcgataaaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaatatatatatatatatatatatatatatatatgtatatatatatatttgtatatatatatgtatatatatttgtatatatatatttgtatatatatttgtatatatatatttgtatatatatatgtatatatatatgtttgtgtatatatatatgtatatttacatttactactacacagttggtaattaatgaaacggaaaacctcagtgttcagcaatagggaactgctttaatgagagcagatagatccatactaagagataatatgcagtcataaaaaagcaatctatataaactgatgtaaaaagtatttaatagctattaagagaaaacctacctactgaactgtttaagtgtatatatagcttgcaaatttggtagaataatttaataatcaaaatgtgtggctaatcggggaagtcagggcttgttgagatagtaacaggctgcatctcctatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtatgtatatatatatatatatatatatatatatatatatatatatatataaagaaaaagcacgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctggaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtattatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtcataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaaggaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaacacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttataacacgcatggagccatctcctatgatatcaatgccttcttctggatacctcctgaaggacttgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaacaataaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcactctgacgttatgacagctacctcactaggcaataggactttttcagctccgttatcatcttacgggattgctatcatatatgtgttcctctgtagatcagaacatcgctatgtggcacatgaccgaatttggacaaatgtgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgctgctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaagtttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgatatcttctgctgacatgatagaattgaaactctattttatcaaagttggaactgaagcatggaatggaattaagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcttatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagtggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaatctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatctgatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcaacaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccattctcatgctactaataaagacatacctgggacagggtaatttataaagaaaagaggtgtaattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccgcaactcagcacagttgtatcataatcttgggagagagtgggggcaggtattgctattctttttaatgctccttcagcatttcttagatggccagccttgagaaagaaccatggcctaaagcacctactcctgagttggtaagtggtatcaaaaatatacaaagacccaattatgcaactgttagctatttgatttagaaagtattgagtgccggtgatgtgccaggtcctgaaactgcagttgttctcagtgtgacctcacttggtacctctgatgatcccaaaggggtttgtgagatgcccaagggggccatgttggggcaactgtcctttctccacttgcccatctattcctaggaagcagatgtgcccagagcttgggctgtagaggcagaatgaacagatcagagaaggttctcgctctaggcctttctggatatgggaccacgagctagtcagtcaatctctctgagactcagtctcttctcctgtaaaatataatatgatgcttatatatttatagactgtgcattctcattggggctatatttcccccacaggggtgaaataggttcgagggtggggggacaaaaattgcacttacaaatgtaaagtatagatatacttgtagtacctaaacagatataagtatatctgtgatattaaaattttacaggaatagtggcaattagaaaaaaatacttaaaagagcccttaggggagtagataatgaaaaaaacaaaagttaagcaaccctgctatagaattgctatgaggctgaaaggaggtatggacttgtacagtcctttgcatagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagaccccccccccccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagctatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttcggtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaagaaagttcctagcaacaatatttggagccccaaagtggaaatagtccagataccagtcgagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataatgtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttactaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcgtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacatgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtgtgcacactcagagcttagcacctgcctggaacatgcgagttcgtcaaggacatgtcttgattgagtgaagtccatcagcacaaagtcacttgggcacaggcatcttgctgtgggataaaacgtaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggctaagattccttttgttattgttgttgcaaatgacagaaatccaactctaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggatagaccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatatatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacggtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacaggcacatgcatgcagatccctgcactcccacacatatgcatacactttataagtgtcacaaactgccattcaggcttcccgattgtgccattcggagactttttgctactactgactcctgccttcttcaccaggagctcagggactccaccttcgtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattagccacatccctgcttgatctactcattttgttcagtggtggagcgagtgtgggtcacacagctgggagcagagacagtacaactggcaatgtgagagttaccttcccgccagtgctgtctgtgtgatcttgagagcatcatatagcttctttatctgcagaatagcgaggttaaacagcctgcagtggcaaataagtggctcatgtgccaccctactgtcaccgtgctcgtggcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacgaatgtacggcacgtcagtcatgtttcagaggaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctactgggtgaggagactgagacacaatggggctgtttcttgctctggacacttagctagtaggtggcggaagagggcctcagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacacaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagagatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaagtaaaaacaccatacttactctttctttctgagttaagaacttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaatccagacctatgataaatgttcagctaatgaacgaggcaaactgaggtgacccagtcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcactgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaagtggagaaaatatatagcttgaaaattattgtacggatccaagaattgggcctagaattcaataataggctgttacatcttgacacatgcctaaattgttatgtttatgtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtgtatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcgtggagttggttgagtggcagccagtgcggccatccacaggctttcccaagtgcatcgctgcagccatagttagctccccagcagctgctcggggctttcacatagatggaatatagtgttgtcagaggtaaatttccagctagtatataggatagaacaagataatgtaataaaatgtacattttctaggctctctgatatgcttctaccctcctatctcttgttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcatctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggatagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctccaaccttgttacaaacaattcagaagggaggattgtgaaatccttcctgctgctctttctgtcttctgccaatcagagaagactggacatgagatccaagagagggctttccctttccccgatggctacactgtgtctcctgcctcccagctgtttatggaaatcagatggtttcctcaactgtctatctttctgcagcaaatcctttgacagagaatgtgcactgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggaggataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacgctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatcttcccaggcgaaaccaaattatttctccttcaaatcgctgcctcccttccccagtcttgttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacataaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggcctctttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagagaccgggtttcaccgtgttagccaggatggtgtcaatctcctgacctcgtgatccgcctgcctcagcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttatgagttacataatttacaatgattgagtgtgggcagctctattatctggatttcattaagatgatgctacaaaaatagtaattgttagtaataataatgctacaaaaacgttgtatacttgcaagatttacaaattacataatttatgatgattgaatgggggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactctagttataacttgcttttgggtttatacctaggagtggaattgctggctcaaatgataattctatgttcaactctttgagaaaccacccaactgtcccctaggagtggaattgctggctcatatgataattctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatattttcttcctctagttcttcttcttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccatcgtgtctacagcgcatctccacccgtacatttcacttgcctctcggggttaactgtgtgtttctgaacgctcatactggggttaactgtgtgagtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccaaagaataactgtgatcatatcatgccctcttcaaaggctgtcagtcttcccatgcttactgagccacaacgaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggtttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaattttttttttgttgttaactttgtccttgttaacattaattctctcatgtcatgtggaaatgagaataattcagatattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactttatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaataggttgtacagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcatgtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctatatgtcttcattttcagacaacctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatagaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtattgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctattacaggacatttatctaggacatgttaacaactcctacaaaaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacacgctctcttgcctgctgccgtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgaaggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactggggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttcctatgtttcaacatgggggtaccaaataattcatttccccttttcccaacagatgcattcttgtgacctcactgatgacaggggcgtcgtttattctaacaaatgctcttgtccaaattccaaccatgttgccaagagatggcatagctggtgagggctggactttaggggccaatctccactcctgagctcccctgaccacacaggaagaaaacattaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacccggcctacttttacgtctcataacccaaaagctctatggcttcaaaaattcccaactcctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcgtaggtctccattcttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaaagcaggtaataactgtcttattctgtacctattgtctgttttcacagtctgctgtgaacccttgctttcagctgggacactgttgccttccactgccttccacagcctctttacttccccttaaacaacctattccaactggtactacttgataatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggactaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcatctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggtgaccttctccctgtgccaaccccggaatacaatgggatgagtaactggcaggtccagatacagaaaatgagtgagcaatgcctttcccagctaaaaattcttccagctcacccatggtgtgctagggaagatgttctcctatgtcctgaatgaccagcagcagaggattcagggcacccaatgcaaaattgtcaccaaatgactgtgacactgaagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggaataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaaccccgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatacgatagtgacagcttaaagattcttctaaaactagatatgaaatttgaatgtggcacctgtctataatttgtaaagcactttggctttttctcagctacatggtgatgatgagttcttctcaacaagtgactaagctctaggggaatcagtttctcaatttgcatgagatacgggagcttcctaagacatgagactttcagttttaaaaccaggatagtcttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccaatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgaccgttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttcgccacctgctctggccaaaaagtttgaaggaggacctatgaaaaatatccctggcctgggcttaagaagccttcaccctcattctcaactctgaggctaccagagcatgatcagttcatcatctcagtcaatcctcccagctcctctattagatccatatgactgccactttgtgaaagatacaaggaggacttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgacgttcagggtttggcgaatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgcaagttcatggagtgcaagggctgtggacaccctgcttgccaatttttctgccttaaccgttccctgcccccttgttgttcaatttctggccaatgtctaaattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgctgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtgccttctggccataagtaccaaggaattcataaagttggattaaatgataacaaaaattggaactttccctttatcttcttttcttcttaaagaataagttaagatacattgatttcatttcacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacattgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacaacacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctgtgctcctgactaccatgtagctcttccctgagagctcctccaagccttggttaaagggccagaccctttgctctctgagcaggaggagagcaacgtctgccctcactgacccattaatagacacctgtcagtgaggaagggaggcttgttcacttcagggagctgtggtcgcttcccctgtgccactggaaaactaataattcatgaagttggctttcaggtacgagcaagctggactgaatagttgtttcaagtcataaacatagaaaagtaagttgataggagaagactatgtggagaaaatttaaccatgttaaatatttgaataaacatttaaaaatacatagcatatataggtgcatatataataaatttgagacagtaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttggtacttagtttctgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggagcaatgtcgttatgagaattccccacattttgctcccttttggacctccctaaaattcccctaagaacacccctcactagtagaaatgtagaatcccagaccttaccccagatctactgaatcagagtctgtatttttaacaagatcccctacattggaggaaagttgtagaaagactgccctggaggatttctaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgtggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcgaggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaccctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgatgcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttattaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgtttggtcccaattcgctgagactaggaattcaaacccaggaaaattgagacacctgtgtatgaaaagcataaagagaaaatttggttgccctcatgctcactcttatgccaagtatttattcaagaattaaatgaataagaatagggatttcaactacgttctatcctcctcctcctcctgcatctgcctgaccttcttgggagccagatgttccactgaacactttgcatgcactgtgactatctaatgcaatccttgggacagatctgtgaaatagagtctgttattagtcccgttttaaagatgaggacactaagattcagatggtttaagtaacctgtccagtgtccacagctcctgtattagctgagagtcttgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcaggctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctactagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaaagagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatcctcctgcctcaggctcccaaattgctgggattacaggcatgcgccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaataaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaacggtgtcttccctttcaagagacttttctagtaagaattttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacacaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttactcttagcagctcactagttgtttaacatacctaatattaaccatctggtcagggagctaaatacaatgaagggcatccagctattatcccacccatttgcctatcccaagttatgttttattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggatgttataggtagcgctcttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtattcatcttctctttgtggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaataggttgagtaagtagaggtgtttttcttgcctaacgagaagtctcagtgtaggtgatgctgggtttggttcaactattcaacagtgctatgagaaattcaggctattcctctacttcatctcagcatccttaattgtctggctttaatcttcatagttttccccttatattggtctgttttcatgctgttgatagagacatagctgagactgggaagaaaaagaggtttaattggacttacagttccacatggctggggaggccctagaatcatgacagggggcaaaaggcacttctttcttggtggcggcaagggaacatgagaaagaagcaaaagcagaaacccctgataaacccatcagatgtcttgagatttattcactatcatgagaatagcacaggaaagaccagcccccaggattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatgcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaattcagaagtgttctgaatggcgtcatgaaatactatgttagtgccagctcacatcctttgctgagagagttaaacgtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgcagtatttcaattccagatctaccatttataagctgtgtgtttttgggtaaggtactctgagacttagtgttctaatctgtaaaaggggataattccttccactggagttctaattaagactcattagggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaaccgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcagttgtttatgccatgtaggaaactgatcaatgacttaatttgacgtgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccagctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctgttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcactttggaataggcctcatgcttgggactgcctccgtcagtgtgcagccttcagcggctacatttggaaatggtacaagtattaggttggcgcaaaaagtagttgcggttttgccactgaaagtaatggcaaatacttagaaatatttagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgagtttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcattaatatatgatcaatagattttttttggtacaagggcagaattgagtagttgcaatacaaacagtgtggattacaatgcctaaaatatttactacctggttctttatagacaaaatttacagactcctgaggcagggttttatcaattcctttccatgtctatggatttagatataagcgtatattttgttaaatattacagcagactttgaggtggctatcatctccattttacagatgtagaggatcaggctcacaggtagtgaatggcagaaccaaggatgaattccagcccactaacgtcacatctctatttgatcattagcgtatagacttttggtccttcataaattttactttataaagatattttacgttgtataattgatgtcatggccatattgtttaatcatcactcaccatgcacctattgtgtggcaggcactattctatccattagggcacaatagtgaacgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcatacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgaatgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccgaccaatatggtgagaccctgtctctactaaaaatacaaaaatgagttgggcatggtggtgcacccctgtaatcccagccacttgggaggctgaggcgggagaatcgcttgaacccaggaggcagaggttgcagtgagtcgagatcgcgtcattgcactccagactgggcgacaaagcgaaactgcatctcaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggcatatttttcccattcaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaagaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccaggttttcccaaatacacctattattaccccaaagagtaggaagccgatcttatctagattcactcaccaaatctagaatctcccaagagactccaaatttagtacattaatttttcttaagtataacattgctcagtaactatgtgggtgaagatctgaaagttctgcagcactgtttcatttataaaaataaaggtaacggtacttttgcgcaagatttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttttttttgaggtggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaactcctgacctcaggtgatccacctacctcggcctcccaaagtgctgggattacaggcatgaaccactgctcccagcccaccataagtactttaatatgctaatttatttcaaacaatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattactcagcaattaatcctcattgttgtaacaaatagttacaaaattctcgttgcatggctctggcttaactgcaaagcaaagtagaaaatggagaagctcccaggcaaggccaacaacgcctggtctgtgctgcacgtgaagatatctgagcacttgtgacccctgctttgccctctttgtcattgcaatggggttactgggaaagcctctcccatggtggttgacaagagggaaactttgggaaatgttctcaggagtaacccacattattttcacgcctgaaagatgcaaggttggatagagagagaagttgggctgtggtacgcttacaacagagatctcaactgaccctgcagagagctttaagatgaggagaacccttctgtgttgtccttactcaggacaaggagctgaggtcttatgcctccacattgactagtcattgaatgtaggctcatttcaggaagggagtataatcttgggagaggtgctgtcttcagcagaaggcaaggcctcttagtttatagctgtcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatgggatgaatcatacctatcctcaccctgcttttggacactggtatatcctctcaaaggcattaataactatgttataatgcaaatatcacgttatctttctatgatttttctaacccaatagactgtgagttcttcaagcttatgtatttgggtacagaacacctcgccaaaatccttggcatatggtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatgtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcgctttccagtcgtgtgtcaatgcaaagtgagcggatttgggtttaactcccttggactgagtgcaattatatgttgggaggggactaacaaggtagcccatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatattgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgtatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatataacactagtcttctatttttatttttaaataaaactttgtaattggtaaagtcacagaatcagtgtgcatatgatcaaagtctataaaataatgaaccatgcataattgcagcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgtgttaaataatattatagcatttcatatatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtgggtgtgtatgtatacatacacatatacatatatatgcacatacacacccacacacacatacataaagatagtgttcatacatataagatctaacttctaagatatataagatcctattctaacatatttaatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccgggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagcactcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataacctattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcagggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagttcatggtaaaggacaaaaattatttgtcaaatattgattgagcacctactatatgccagacactggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcatgtcatcccagctactgaggaggctgaggaaggataatcaattgaacctgggaggcagaggttgcagtaagccgagatcgtgcccctgcactccagcctgggagagagagtgagatttcatctcaataaggaaatagtgggtagagtggccaggacagggctcatggagtaggtgacttgtgaggaaaggtctgaggaaagtgaaagaactgctgtggaagacagaaccaaggccccaggattgttcacattctactccttggaacctgtgaatgtgttaccttatatggccaaatagactttgcaaatgtgattcaagttaaggattttggattatgttgatgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctggtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggagcaaggtggtgggaattggataagggtaagagggtaagaaatagttatattgtgaatgtattttgaagatggaggtcattaaccagaaaagggtaaatgtgatacatgtaggctgaactggaagagacagtgaataaaattcctttgctaattaaactttcttttttttttttctttttctttttttttttctttttcttttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagcggaatggcctgtgttcaaatgctggcttctctaacttaccagaattacgtatgtccttgagcagagtgtttaaccttcctgtgcctcactttcctcatctgtagtatgggatacatcacagaaattgtgtatcaaagggggaaaatgtttgcaagacttagtgcctaattcacagtaagtgctcaaaaaatgcacacagtaagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatctggggcctgctttccccaggatcaccgtaagattctacctgaggagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaaattgatagaaaccacccccaaatcatcatctaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccacagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagttattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacgtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaacgggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaactgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttcccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggttgttgcaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataatatcattggatagtgccatgatagaagaatgtcccatgtgcagtgagaatctagagagaaaataagtgattacacttaaagtagagagtcagggaagacttcctgggagaggtgacatttagactaaagcataaataatattgatttgtttgccaaatggaggaagcaaagaaggatcctgagtgaaagcatgatgtgtctgaggatttgcaagtcgatcatgaggttgcagcatacatcacatgggagagagttgctgactcttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcgtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggctttgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagtaaaatatctgtacctttttctttagcatcgaggtatctatttaccagaccttcgtgagcaccgtgcagtttattttttaaaaatatttctcaactttatagtcagtatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaaggaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgacgacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcagctgagaagcagagccaggaggacagtgatagcacttgaggtcagagtggtcatcgggatccaagcctgctggatcttcctggccttaggaaacccagaggcttcatcctttggcaaggggaagcctatataccctgtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtgtgactttcattactggagatgttgtttctgatgttgctggcggtccctactgaaaaggatgcatgcatgaagactcaaggcaacagtgacttgcacccatttctaacaatgacttgcacccatttctcccgtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttagggagcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctctgggaaaatgttaaagctgtgattatctagttatacctgaataaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcatacaatgtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagactgtccataattgggctgggctgactgcatgagtctcacctttcactgttctcccttaattccctgcctgcctggaagacgtatttcagcttctgcaatgctttgccttgctaaaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggcagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccatacctcacggggagggaggtcagggggatggggcggggaaggaggctgatggaggagttgctgactgcaggtagctggaggcctcagccttcctgggcagcagggatacgggcagggatgtcccctgagcatggtcccacctggaagccagggggctgaccttgacacactcctgaccagtcagtggatggcgctgcagccccttctgtttagtcttcacatcagcaatgaaagagggtgaagttcatggaaatattgtggggacatatcgcatggtttctgttcatgaaatgtccagaaaagacaaacatatacagccagtggctgtggtaaagtgggaatgactgctaatgggcatgaggtttcatttaagggtgatggagatgttctaaaattatatgtggtgaggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactcctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggctaaagatgctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctaccgtttctgcagttctttagagagtgcagaccactttcacatgcagcttctcatttcattctcataacctagaggacgggcacattatcctcctttacagatgagaaaatttccttcaacccctctgtgtcctgtctcgaggggagcagtattgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttccttaagatgcccaccgtgacgggcccagagagtcgacatgcacatggtgacttctctacaatcaatacctccagcagcccccgaaccctgtcccttccaggtactgtttttcccgaatcagagcttcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggattcagggagctgaccactctggacacccgtgaggacagaaatatcacccatttgtgggtatgaaaacacaagaaagcaattcatgacactctatgcaaggttcattattgatgacacggtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttcttttttttttttttttctgagatggagtctcaccgtgtcacccaggctggagtacagtggcgcgatctcagctcactgcaacttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggggctcatgccaagtgcccagcacattggccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaagctgttgttaggattgagatgcttgcttctgatgatgcagaagacagttttaattagtatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcaggttatccaccctcctcagcctcccaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcgaactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttagtctgttgattgcttattttgctgtgcagaagcttttaagtttaattaaatttgaattgtccatttttttttttttttggtcatgtttgcttttgaggactaggccataaatcctttgccgaggccaatatctggaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagatgagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattacgggatcaacatggtagatgatgttgaaattaagcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgtacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtggttcacgcctgtaatcccagcactgtgggacgctgaggcgggaggatcacccgaggtcaggagttcaagaccatcctggccaacgtggcgaaaccccgtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacacacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatattttcatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagatgttttttgtagaattactgcactgctttgcaaaaactatttatttgtccctgctttttatgcctttgaaggtacgtattttcctttttgttcctgcttgtttctatttatctgtcttactctttatatctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacgtaactggttcttgatttttttggtcatattttattacaacctgaattcctgtaaagaaaggagactcatatcctgaagaatgaagacatcaaaagcaaggtgctgtggcaagttagcccttggtggagggtttttcacaactggatatcctgctgtgtagaactgaatacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggtgtatgacccccccccccccccccccgcccacagacacacacaggagacaacccgagagatcactgccagccctgggaaaatgagtttgcctcctaatttctggctcttttccatggtgcattctgccctagactatctgtcatagttttggaagacaaggtaaaacacccagtcgtgaacatacttgctcatacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgattgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctttgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagttgaatgtacctttttcctgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataatctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccaggcatttcagcttgaattagcatccagactcagggttgttgaagaattttcaaattggactagaatgttcactacctaatgaatgtctggatctaagccaaacatggctaaccctactgtcctgcttagtttttacaacagccctataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaacgcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatgtgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaaagtggctgtgatgcaaggaggaaattgtcacaaataaacttggagaaatcatcaaaggctggaagaggaaaaattgtaaaaactactgtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccgggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatatccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaagcccagctactctggaggctgaggcaggagaattgcttgaacccaggaggcagaagttgtggtgagccaagatcataccattacactccagcctgggcaacaagagcaaaactccatctataaataaataaatatccctgagtcccaccattggggataaccgctgtagacatccgagggttttacctctctatttttaaagtgcgtatacattcataaagacacagcatcaggctgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgcattttccacttgccaatgtctcagaaaccttcttcatgtccttcatcaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcacactgcaggacccacccagtctttgaataggaaagcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccagctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatacaacctgctctgcatcctcttgagtgctttttaaacttccctcgtctcctccttcgtttccaggctttctcacccactactcctctttgccgttcctctgcctgactctattaagataaactaatccttggaatttgctgctttgaagttgatgtcggctgggaaactcatacacaggcgtgtcccagtcctgtggtctagaatcaacatagtgagacgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccacgagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctctctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgcaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatatgtgtatgtcacgttaaccagaatggtattcaacaggcatccctaactgcagcagcagctggagaagtaagatttagttgcaaataccaataattcaagcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaaggtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttcttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattctcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccatcataagctgtaactacaaattcaatggaattagtatgaaggtaaggagccagcaggttctggtggctcactgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacggggtttcaccattttggccaggctgatcctgaactcctgacctcaagtgatccacccgcctcagcttcccaaagtgctgggattacagatgtgagccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactctcgcaccatattaactattgcagtatggtgttattattattatgaatatctaatacagttaatatctttgtacgtaggagttttagcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacatgttactccaagatacagtagttctatggtaaggttggaattacattatttcctctctatattgaaatattcagcaactaatttcctgtagcttcatagtaaatcatgctaatgacctcagaggtggaaaccaaggtggtgagactttctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaaacagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctccccataagacccttcacttctctattgacatcattttcaccttcaactccacactcagatactgactcatacatatgattgattctcacctgcctgtgtcttgttgatccaggtctcagcttagaaattacttcctccaggaagctgtctccaagtcctgttcagatatctgtccttatagagcgttttttatctcacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaaatgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacggacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactattagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaaaagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagaggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgacgacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagtgctcttcaaaggagcaattttctaaaattcgaacaagggtgtcatagttaataagatggaattctccttttctttttcttattatattttccaaatcaagggcagtagattccagaactccaatgacgtcaggccactgtactttcaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggtcacagacctctcctggtctgacactgaggagtgaccagtgctgactcagagcagcccatctacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttccaaatttattttcactcacaattcctacatagtcagacaccttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttgaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatatcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgacaaaccaccaacatttccctcccccgccttgactgtgcatggatttgcatatttatagagttaaagaatcacccaccatggttctctttcttatccacattcttgtcttacccatccgtctctgtcactctcctgatatacctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaataacagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctgtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtggccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcagttgcctgttgcacctcacaattagctgcctaagattctaggagagaagcagttggattttatatgtgaaaatgcctctatttgctgcatttttactttttgagaagttgcaagttacatgaaaataaacatactatataagaaaacacggcagatttctcctggtgttttaataattccacgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtatgagggttgaaaaactactagatgctgtgctagctaggtgacaggaccaatgatactcaaacctcagcgccacacaatatacctaggtaacaaacctgcacttgtacccgctgaatctaaaacgaaagttgaaattataaaataaataaataaatgtggtgcttatttttaaaataaatgaacaaaaaaaccccaaagagcttagctaggtgttaagtaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatgacagagtcaactttacctaacttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatattcacatctatatctatactcattcatatatattcatatgtaagattaaactatatgttcaaattgtattctgctttttaaaatcacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataattatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaagccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccctgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcaagatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagaacacagccaaagatccctgcctctcccaatcttctgggcctctttctttaggaaacaaacataaacctgcccaaactgaggttgtaccctttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagtatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctgaattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagaattacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttggggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttggtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattcggctctgtttctttttctaatgagccagtgtggagactggggaagaggaagggattgtttggaaagatcagagcatccaggagaaactgtatggggatgggggcaccactgactgaatcagagcctccagtttgctttgggtgaccacagagggactgaacaaacccctgtgttgtcagtccttagttttgagaatagccttgaccagcacacttgttcactgaggaaggatacgaaaatgcagataagttaaaacaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtttttgtttttgtttttttttcagtagagacggggtttctccatgtaggtcaggctggtcttgaaatctctacctcaggtcatccacttgcctcggtctcccagagtgctgggattacaggcgtgagctaccattcccggcctcaacctactttttaaattaatatgcttcaacacatttccaagccaaaatgacttgtaaaacgttgtacttaaagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaatataattccactgagcatcctcaactttgtgcacattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccatccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcacggatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagccctcctccgccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcgtttccttggaataagacctttaattaatgctcattaagatgcacaaatagcctggccttgaatcctcccagtgtttggttcactctcccctaacttattaaagttgcttctggaagttacatagagacgtgcagttaattcctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattagccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaattgtcctgttgactgaattttgatcacattattgggtatttgggatagaaatgtgtagacagagagtcagaagtcatcacatctactgaaggctttgcagccaagaaatgaggcctcaggcaagtcatttagtattaggggacttaatttcttctcagtccaaggcaggtgtttaattgcaacgtgtcccaacttgactaggggagtttgttcacagaatcaagcgaattcccatcctcaccctcacatttggatttgataagtctgcagaggggtccactggacctccttgctaacaagctgtgggtggctctagcctaggtgcccaggtgccccataaaggaaccactatgtggttaataccagaagtcccgtcaagttggaagcttctctaaccacatcttgggctgtagtacttgacaattggcttttcttcaataaagcaaaaataccctcagttatgtcatcattaaaatgtacatgagctagaatcttatgcctgcctggttctgtgagttcaaaataagagaaactcaggaaggttgagttgagccgcatgctgaaaagagggggagaagaggggatgacttggagccaggaaggcttgtgggacagagcttcttaacctggggtgttcacccttggtccctggatggacttgagggagtctctgaatgcctgaaatcacaggcaaagtgagtgtgtgtgtgcatgtgtgtgtgtatgtgtgtgtatttttctggagagggaaggaccacagtttgcatagatttcccatggagatgttgattgcaggttggtcagaaccatccttctaactaggtggtgatttggagcacaggcgtcgggcacagagaccctgacttagagcccatctcttctattaattagctgcacacagaagctggattcccctccaagcgtgctctacctgtggcaaagtgctattgtgggactacttgggaacataggaaaagtgtgcattgtctggtactcagtaattgctcaataaataccagctacatcctaacaaatattttatggaggtccttaaactgagcaagagcaattttacctgatgcattttgaaaggaagtgatgattaactaatccttcctgcctcctgctagtcacgccttacatcaccatattgtctctttctcctcatctggatctttcgctaaagactgacaaagaaagcttcctctgatggctctggtctccagctaaggccataaactgtgtattgttgaggctgcaggagaaggtggaagagtcataatgccaggttcagaccccttggtcttctgtctgccatgggtttgctgtgctctgctagggaaaataattcatcttttgaacccctctgggacatttctgtgagttttgttggatggtcatgtgtgttcactttatgatctccacgtgaaaggtgaagttcataactgccaccagtctctaagctttgtcctttaaagtctgcggacacttgaagccctctgttagtcatgccatgctgtgatcaaaaggattgtgtttaagaatgtatagtctaaatgcttattgtgatcactaacatttgtatagttctttggggtttaccaagtactttacttgtattttctcatttaatcttcacttaggactaaaaaagttagtaacactaatgggaatgagcgaaaaccaaattcagacagtattaaatacacaaaattataaagtaaaatgagactgatttcccacgtcatgaggaaaaatgtctctttactttgtgattctttttatcacatacttaaaggcatttgcatttttccttttctgaattttctgcttttagtttttcctcttgtattagatgttcagtgtaactcaccaattgtggcagttttctgtttgattcacagtaaaaaagaataaaaaataaaaattaaaaaaaaactgtgacctgcattgtccacctgattaaaattagtttggatttttcagataaggttccttctttttattattataaacagactttatcttaagagtcggaagaaacatttaagggaactattcgtcttatttgtatttcaacctgataaaaggaaaagggatatagcaaaaatttttagtcgtttgagtgggaagtgctttatttgagataaacacaaaaggttttaagtatcgttgatattagtcaaacataatagcttttggctattgtctgaagagctcttgtctgttgacttgcagacctgtgacctctagataaagtttcaaaatgcagaaaatatttatcttcttgctatgaccttccacgcacacgacgtgaagccatggatttgtttcctagggaactagtgagtgaggaagatctataattaaatctgtgagttatatgctacacatgggaattgggtacgcaccaagtcctttagaaaaatcccataatatcaccatagcctcaactggtggaattaaactcaatttttcttcacacatttttagaaagcatcattcagaatcttaatatgggaaagttcttgtgtttctttccaaagtcagggtgtgtttagtttggcttccatttcgctctggatccagtgtccctccctgatgggacggcacctgccattgctactcaggtgagtgctttatatggaagtcttggaaaagcgagtggtagtctagtctcagacatcagcacgtcagagctggaagggatccaaggcagtgtttggcaaaagttttttgatgttcaaaatgtgtccttcaaataaaatctaatttaaaaattcactgagtgaagcagacattaggtgaattggttttgactagaagtaagggagaaagaaccttttcatcaccaccccaatcccaaaattccagagcaagaagtctctaaggcacccccgtttctcaacttgaacattaacatctaagccatagcactgattgtagagggggcagactgaggctcaagagatgttgccattggtcagccatctcatagcctctagaggttaaacacacacacacacacacacacacacacacacacacatacacacacacacaactagtaaaaaaaaaaaaagtcagaacaatgaatagctgtttccaaatctggcttgaatatattttgtagtaaatttccccatctagaggctcatgagggccaagatttctctacggtgcttttatttttcaccttttgaaaccaataatcagcctcttacattaactctaaaaagtaaaactctgtcgactctttgctttcaatgggattgtcctccccgtatcattcctcaaccaacagagggactctatgagagggaagcagaacctcaggactaccagagaagagatatttcacagataccaaggcttgacgtagatgtgaggccaggggcagggtgcggtggctcacacctgtaatcccagcactttgggaggctgaggtgggtggatcaactgaggtcaggatttcaagaccagcctggccaacatggtgaaacctctcctctactaaaaatacaaaaattacctgggcatggtggtgcacgcctgtagtcccagctactcaggaggctaaggcaggagaatcgtctgaacccaggaggcagacgttgcagtgagctgagatcatgccattgcactccagcctgagcaacagagcgagactccatctcaaaaaagcaaagatgtgagtccagggtgggtgttgatgaggacggtaataatacctgatgctttcgtagcagtccctgctccagactatatatacattagctcatttagtgtttgtgatgtctaagccgtgtgtgtgtgtgtgtgtgtgtgtgcgtgtgtgtgtgtagtagcagcttattttttttctatttctctttgattttttaaatacacacttataagtgtacatgtgtggtgtgtgggtatatatacactttcctctatctttctgatatacctatctatatatttatgatcttcccaccaacctggtaaggccgatactactactatccctattttatatataaagaaactgaggcacagaatcctaagggtcctacagctggtcgtggcagcactgagatttgtatccaagcagcctggcttccaagtctgtgctctttgctggtctacattcataccccatcttttatttttctttttgaagtatacgctatggggctttgagcaaaacttctgatgtgaaaaagaaataagaataataactccaaagatttttgctatgaggataaagcacctgacctactgcaccttgtaatttctggcaactaataatttctcagtaagtttctgtgttgctgtaaaaattgtcaaccatgtacacaaacagatctttaaaaaaaattgagacaaattaaagtgaaagacttcaaaatcagtttgtcacatttgatgctaaacgctatattttctctgagaattttaaattgtgcaggtaatttctcaccacggtaagtcatgatttttcatacttgaacagtatcacttcatctaaggaattttccccagtgcagtacactcccacccatgcctctgaaaacgtctaatctgtttctcctacttacctgttggtccaattcatttctggaaatgttctgcaggttatcataacgagaacaggagtgatctatggaataaacaggcactgttgtttgaattaattaccaggaacagaatcataagtggtgacaacttacaacagctcattccacattctcctgccactgatggatagatttatgcatttgaaacattttttactgattgcctgcccatctcctgttcacatactccctgagaacctctatgtcttatccatggagtatgtccgaaaaccaattatcatcccctttttgtttctgtattgtctaatggaagaaaagaaattataccttagaggagatattttcctgataaacagcatttagtcatttagtcattaaattagctcttttaaaattgtattatttttaaaggcatctttttattttattttattttattttattttattttattttattttattttattttattttattttattttatttgagacagaatctcactatgtcaccaggctggagtgcagtggcgtgatctcggatcactgcagccaacctccgcctcctgggttcaagcaattctcccgactcagcctcctgagtagctgggactacgggcacataccaccatgccaagctaatttttgtacttttagtagagatggggtttcaccatattggccaggagggtctcaatctcttgaccttttgatccacccgcctcggcctcccaaagtgctgggattacaggcctgagccacagcgcccggcctaatggcatcttagtcattcgacttttcgagacagccttatcagtagcctctgatgcttgaggttctcttgtgttgcttttcgttgtcatagtatttttgttgttattgttttgtttttctttctttttgttatttgctttatgtttgtatttgtcgtacgttgtgtttaatctaccccttctctgcccaagactgtagtatgtcgtcagggttgagaaccactgggttaaggagttacaaaaagttaaatttctcagggctaatgttgaattcttgcatcggatgagctcattgtaacttaggaaaatcaaaagcttgacttgaaagaatgagacaagtcaagctcttgtgagacaagccaactctttctcatgtggaggaagagttctgatggggagaaggagctgaagaagtggtgcccccattgaagcaggcagctgggatcccctgtgaaggtggtgaagggcagatgggagacggagatattttaatgaaaattgtaacctattttatgaataaaatttattttttattactgtaattttttttttgagacggagtctcgctctgtcacccaggctggagtgcagtggtgtgatctcagctcactgcaacctgcacctcccgagttcaagtgatcctcccacctcagcctcctgagtagctgggactacagttgcctgccaccacacacaactaatttttatgtttttagtagaaatggggtttcaccatgttggcctggctggtcttgaactcctggcctcaggtgatccacccacctcggcttcccagagtctggaattacaggcgtaagccaccacgcctggccccaaacaaaatttaatttaatccttacaacagtcactcaaaggaagaaggatatttgcattattagagcaccttcatgagcttgacatttttatgttgctctttgaatcctctcaaatgccagctgatttaggtttcatttttcccgtcatcagtgataaaaccatgacttgaggcaaaggtgactattcagaaccagggtttctgattctactgcctttttctactgcttggatacagcctggcctgaagcctcagggactttaggatgtagattggcaggggaaatcccaggcaggggtgttttttgatgggagaagctgtttgcaacccgcagctctggagtgactcagagagagaaatgactaatttctccattcagcaaaaatgcattgagctccagctacatgatgaggactgctgtaaattccgtggacacagcagtgaacagaacagaccaagccctgtcctacagtccacctgctagtaagggaacctgacaaatcaaaagttaataaaatacatggtgtgtcagttgctatgataggtcctgataggggctatggaggtcaatggctagagatgagagtaggttgcagttttcaacagggaggccctcagtgagaactgatgaactgggatgagtgcagggatgcatctatctgggggctgagcatcctcgataaaaggaactatgagtgcaaaagctgggggcagtagtgtgtccagaatattctagaaactgtaggaaggctggtatggctgaagcagagggagcaagggaatgttagataggagaaaagctgtgaccagatcacagaaggtcttggagcccaccatgaggactttggcctttattctaattgagtgggaaagccactggtgggctttggtgaagacagatgtgatctggcttatgtctttattgaatggctctggctgacggatggagaatagaatagagtgtggatggggcaagggtaggaacagctgcaatcactcaggctctagaagcaatgggggcttggcccagagcaatggtggtggaaggggagaggcgtggttatggccgtattctggatataatttgaaaagatttgtcgggggaagtgaggattttagctctgttttattgagtgtggttgcctgcaaaccaggctctgcgcctctctgaactgtcatgcattctttttgagtcctcttggtggttttgtaaagaagccagcctcgctgcccatctcccagaggggggaaactgaagctcagagacattcagggatttgcttaaagccccatgccaggcgttggccatggtcctggctcccaaacctgtcctttttctactgtaacaggctgcctcccctccaaagtctgcaggaaatttaagcctcctggaatttcttattgtatcagcatgaatattattaagtttcctataaactcaaattttgtgtatttaaaaagactatgaatctttctttttagaaattgaggtggttaggattaatgaccaaccataaaattttataagcaattattacggtttactgtaccttcttcagctgcttgtcgccttgccttcttttctttctcctgtagtcggggtgagttttcacatcactgacaaagatattgggctgggaagaggcacgcttggagtgagacccttcaggaagcctctgtttttaactttagctgtgacactgggatctcagtcatggaagttcactgacatctactcatcctgcattagtaatatgggcatggtgcattttctgtatttattagctatgtttaacagaatctttagaaaggaactcgatgccctgtttcaacaaagtacattgattttttgctttgtgatagataaggcaaaagcggtcactttgttcggtgtgtgctctcatcctaatttagggcccctttctgcctagaactctgtagatttccgccgtctgtgtttttccatcatcccagaccctcagctgcaagctcaggcctccagcccctcatgcacaactgctcctttagatcaggattactttgcccccagtctccctgggacttgctgcagatttatttcaaagttgtaaatcctctgtggattacctcctcatgctattctcaacctctggttctttctttttctgattgcccccaatattaacaaagtggagcaaaaataactacagttgctggaaagtggtactgtgttagtcagaacacagaggttgtatgtgacagatacacgttcacatggctaaggctaaagggtattcattgactcccatagtcaggaaatccaaaggtgcatctggctttaggacagctggatccaggcctcacacagttgcactttgtactctccctttgcgtggtagcctgatcttctcctgccacagacacttggtcaaagaagctggtcacaagctgcatccttctagcactgtgaatattaaaggcaagaggaatcttccctctgagcctggtgtggtttggctgtgtccccacctaattctaaccttgaattgtagttcccataatccccacacgtcacgggagggacccaatgggaggtaattgaatcatgggggcggcttttctcatactgttctcatgatagtgagtaagtctcatgagatctgatggttttataagtgggagttcccctgcacaagctctcttgcctgcccccatgtaagacgtgactttgctcctcattcaccttccggcatgattgtgaggcctcccccaccatgtggaactgtgagtcaattaaacctctttcctttataaagtactaagtcttgggtatgtctttattagcagcgtgagaacagactaatacacacatctaacaagaataccccaaggagaatactgtttggtataacattgggcaaatgcccattgctgtagccatctctgaggccaaataaatgggttccgcttggctagaagtacatctcattatgagtggaagtgggggaatgtcatggcaccatgattgtggtacagctgattgtcatggggcaagtgggagggttgatgtaagaaggggttggaaagcctgctgggtaaacaaatctatagctactgtccttcaccatagttctaccaaagtcaaattgcatttatagcactggagtttcacttaaagggaatgcagcactggggacagaccctagtattttttccaattgtcctttattttcagttgccaccatgtcttgagcgcctgccctatgcccccatactgttctaggtacatatgatggcaaaatgatgaataacacattgactctgccctcacaaatgctgttcattaggatgggtcttcctaaattatagagactgatcaatttacatgccaccctttgatgctaactaagacaatggagaaatagccccaagtgctaatactctgtctcttgaattgagttatttttccaaggcagtaaaatgtgaagattgcaattagttaaccattatgaagacaaatcttcaaatatttttctcactgtggtgacatttaaaatgcttcctgctcaaccaaacagccaattgatttctttcccatcttcttataatggctaattgctaagcaattgattgaatcctcttttgttactatgtaattactaagctggccaaaacgactctcccgaccatttctcagttggctcattttggtcacctataggacaggtttggggtgggaatgttcttatttggttaaactttttgcaaataatcaatcaaattgctttatgtagtgattccgagcaaaggtccaactggcagaaaggcttacatattacttggatagtttcttaacctaaactttggtgaagtttttgttgttgttattgttgttgttttgtctttgatatggaaagaataagaacctgcctcctgaaattttgggaagggtcatacgagataatacattttcagtgtttagcaccactgggacagaataagcctgtaacaaatcacaagtgttaatagtttgtctaggccacctctactgcatgcttatgggaacatggtcaacattgttaacttttgtgcctcagtttcccaatctgtaaagggaggataatagagccactcatcatcaaataaattagagtttatttgatgattgtattagtcggggttctttagaaggacagaactaataggaaatatatatatatatatatatatatatatatgcacatatatatatatacacacacacacacacacacacacacatatatatatatatatatatatatatacacacacacatatatatgaaggggagtttattaaatagtatcaactcacatgatcacaaggtcccacaataggccatctgcaagctgaggagcaagggagccagtccaagttccaaagctgaagaacttggagtttgatgttcgagggcaggaagcatccagcatgggcgaaagatgtaggctgggaggctaaaccagtctaggcttttcacgtttttctgcctgctttatattctagccatgctggcaactgattagatgatgcccacccagattaagggtgggtctgcctttcccagcccactgacacaaatgttcatctcctttggcatgatcctcacagacacacccaggatcaatactttgcatccttcagtccaatcaagttgaggctcagtattaaccaactcaatgataaaaagagagagcaaaagcatgtagaattgatatgacggttaaaggggatagttaaggcacctgaaggaccaagcccaccagcaatctgcacggatactcggtcactattttgttatttataccacctggcacagttcctgccttctaattcacactcaagcctcaagcaagagccgttcctttgcctccattcctcccagagattccccttcccatgctgaagccttggaaattattgtgaatgcaataatggtggccgcttctgtaaacactgtacttgaccttcatgcccacagtattcagcaggtaactacgtagtgtctgttgtgtgtcagggactgtgctgtggattcacttctgcagagagcagagggtagatgcagaataaagggtcttctcctgccttgagccgttcagagttgtggcctttggaagacttgctcagaatgatccagtgcttttttgacatttctggatatgatcactagctgcaatcttgcatttggtgctttttgtgattcccagctctccctccacatgctctgagaaaagtgatatccccagagctgtatccaaagaagaaatgtaaatccagaggctataaactaataggatctgagtttccgtggttgactgtatgaaagtagatttggcttctctgtgttgctgactttaacagggagcttaaaatgtgagatggagcaggtgtttgcgtgctgtatcaccaagccgttcccatggctgtgaattccgggaagttgagggactatacagacactttatcttgtggtgacctgatgcatgcaccaggccactgttgcccaacaactgccccctaagtgtgggtggaacggccattgcaatcgactcggggcgaacagtgcatctaaaagatgaaggtctgattttctttgcagagtttaaatggtgcatgtgtctttaccccaaaaaccacagaaacaatttctcttaaagagaaagagaggaactatgtacttgggctttgtatttggagattttggcaaagatggaggctgcccatcatgggtgacggtagaatctggtgtcagatggcacactcggagttgtctgactcacttggagagtacaagggcatctgcacctacaggcattgctgtgaatgacagaatcatcaacatccagggaaatgctatacttgaaaaaaaaaaaagatcagggtattagccgtggcagctatgtggcttctagatactgagccatcctagatgctagctctttacctgcatgatatcatgcaaatcttggaagcaagcctccaggtggattttattcctattttacagtggagggagctgagggctagagaggtttagtaatgtgttctctgacacatagattaaaaagtggctgagcaagaacttgaatcgcaagccctgcatgccagttgcgagccccaaaccctacctcctggggagaagacacacattgtatttctcttctcttcatgggggttacagactccgttatttcagagcagaacctaggttctctataggatggggaggtataaggactcctttctatgcagtggaagcctgtgtggtctccctgagaccttttcccacaatctctgaatcccattcatttgtgcaagagtcaagttcaaaagcagagagcttgagagctcctgtcttcatcacattgttgacttatcgttacatctgctcttctaacttaaatcactggctccttttctttcttcctctgcatcttcaccaaggagtggtagaaaaagaattcaccttggcatagacaagcctagatttgattaacagctcttaaaaaaatcattccacctatttagtgttctgcttccttctctgtgaatagggctaacgatgcctatttagattatgaaaattaatataaaaacagaatagaagtccctagtaagttgcctgtcccaaagcagacacttaactaatgtcaagtctccctaaacgttgccctcatccccacaatacgaggagggaagagtccgatgttttcattagaaaagctgccacccacacacaggatgcttttctctacttctgagtgtttatagtttcagtgattctgtgccttacaattttcaaggacagctcgttccaacctttgcgaatatgaagaatggtttttctaaattatataatagtgtgacctacagatagccttgggctttcctttcttctggctgcagcctttgctaggtacacatagggacatgcaccctgacaatccacgggggccccctctggcctgggtcctcagaatgagaacctcagcttttaggactcacaatgcaaggatgatcacgcttgctgttagcagcgcagatccagcgtaattttaaaagcaaaatgactgactacatagaaagaaaaaccacattgttttcctgtctccccatggaatgctgcctccattagagaaaaaggagaaaacccgattaggaaggatagaaacataaatggaactgtgtcaggccttccaagctgtcactgattattctaccaggcagatatttctcacctcccattcagggccatctcctgtaacagccatttctatagccgaaacaataagggataaattaggctggtcaatttgtcctttccctttcttgggtaaaaagaaaacgacttaactaaatcttttttctttaggatgaaaagagattttaaaaaacattctagtagcaaataactgtcctaaagtaggtaaaatgggaattgattttacttacctgacttcctagttgggtagttgggagcattacctgagacgggtctgtggcaacactttgtgacggccaggcctgggtggctattacggtcatcatcatttcaggaggcaaggtggcttcattatgcttcattcctacaatctcctttttgttcattgatgtgcattctcctgctttgacatacaaacccataacaccatgaaattttaaagcgaatggtaatattttttcatataggtaaaaaaagtatgagaatattccaatagaaataaccataaaacattctttctctttgtttgagtaacccctttcctgggtgtctatcctaaggaataatgtaaaatgtggagaattatttttttcagaggaagatgttctttgtagctttatttacatcattcacagtgtttataattaaaacagttgagagtccattatgattgaagtggttgttaaatgatggtatatctgtcttaaatattgcatagctaaacaaaaggagctggtaatgatagaagaaaatgctcatgatataatatgtgtattatagtctgttcttgcactgctataaagaaatacctgagatgaggtaatttataaagtaaagaggttgaattgactcatggttccacaggctgtccaggaagcagagtaagcagcttctgcttctgggatggcctcagggagctagcttccaagcatggcagaaggcaaagtgggagcaggtgtcttacagggcaggagcaggaccaagagagagatgggggaggtgctatacagtttcaaacaaccagatctcctgagaactctatcacgagaatagcactaggagggtggtgctaaaccactaatgaggaaaccccccgccgtgatcccatcacctcccaccaagccccctcctccaacattggggattacaattcgacatgagatttgggcaggcacacagatccaaaccatagcaatatgtaaagaatcaccctagcaacagtcatcaagatagcatgatacagcaggggagagatacatggatcagtggaagggaatagacaacccagagatacagccacacaaacgtgtccaactgcttcttagtaaagatgagaaaggaagtcagtggaggaaggatagatccttcagcaaatgatgctggagccattggacatctgaaggcaagaaatgaacctcaacctaaacctcactcttcatacaaaatttaactcaaagtggtccaggcccagtagctcacaactgtaatcccagcactttgggaggccgaggcaggcggatcacctgaggtcacaagttcgcaatcagcctggccaacatggtgaaaccgcgtctctactaaaaatacaaaaattagccaggcttggtggtgggcacctgtagtgccagctactcgggaggctgaagcaggagaatcacttgaacccgggaggcggaggttgcagtgagcctagaacacgccattgcgctccagcctgggcaacagagtgagattccatctcaaaaaagaaaaaaaaacaaaaacagaaaatgttaactcaaagtggatcacagatataaatgtaaaacactatgaaactttaagaaaaaagtaggaaaaaatcttagggatctaaggctaggcagagttcttatacttgtcacaaacaggtgtgaaccctaaaatgaaattttgataaattagactttatcaaaatttgaaacttttgctatgtgaaaaatcctgttaagagaatggaaagacaagctatagactaggagaaaatacttacaaaccacatatctgaaaaaggattagtatctaggatatagaaagaactctctaaactcaacagcagaaaaccccaatcaaccaaattaggaaattgacaaaagacataaacagacatttcagcaaaggggatatgaggatagcaaataagctcatgaacaaatgttccaactcattagccatgagggaaatgcaaattaaaaccacaacagactaccggtacacacctattagaacagttaatttatttttaaaaagcagtaacatcaaatgctggcaaagatgtgcagaaaccatcactcagacattgctggtagaaatgtagagtggtacagccagtcaagaaacgagtttggcagttttgtataaaactagacacgcacttaccatggaacccagcaattgcactcctaggcgtttatcccagaaataaaaacttatgttcacacaaaacctgtacacaaatgttcatagcagcttgattcatatttgccagaaactgaaaacaacccagatgtccttcaacatgtgaatggttaaacaaactgtggtttattcatatcatgaaatatggctcagcaataaaatgaatgaattattgatacacagcaacttggaagaatctccagggaattatgctgaatgaaaatgctaatcccagaggttgcatactatatgattccatttatatgatattttctttgaaaatgttatgtttatttttaatgtttgtgggtgtatcataggtatatatatatatatatatgcatggggtacattagatacagacatccattgtgtaataatcacatcatggaaagccgggtatccatcccctccagcatttatcctttgtggtgcaaataatgcaattatgtgattttagttatttttaaatgtacaattgaattattattgactatggtcacctgttcaccccgttatgctctcaaatactgggttttattcattctttctaattttttgtatccattaaacaccccttcgtctcccctccccaccctcaattaaatgaaaaattatggaaatggagaacagatcagtggctgccagaatgtgtatctgtgagggaagaggcagtctctgcaagagaggaagatgtggttgtgaaatgacaacacgaaggatcccagtggggatggaatggccttgtatctcaatggtggtgatggatacgcaagccaatacgtagataaaactgcaaaaaactaaatacacacacacacactctcacacactcacacactcatatgctcacacactctgacacattcacacacacacacacacacacacaaagtataagtaaaatggcaaatctgaataagatctgtggattgcataaatgtcaatattttaattgtgacattgtaccacagtttaacattagggaaactgggtaaaagagtattttttgcaaatgcatgtgcatctataattattgaaaaagtaataaaagtcaattaaaatatgtttatgcagttgtatgcatttaaaagactagaaaggatttatcgacattttagtatagttaactatccagtaggacattgagcatcttgctttctaccttttactttactttctctgccaggattttcctagtgagcatgtgttagttttgtaaagaggaaaaaaagcaaacctggttttaaaaaaaaaatcccattgccaagtacaacaatttacagcactctttttagtatattctgaaatagtctcctcatgatttctttctcttctgtactccaaatgtaacactaaatcacacacatgtacacacacacacacacacacacacacacacaatcatgaccagctcaagaataaatatgtggggactaagcatccaaagctcgacaccaacaatttgcagctgaagacataatgaacttttgttagtggatggaccagctgggaagactgtaaagttggatgtcttgttgtgctttctatttattattcagatctccagtccagtgtacagacagaaggtgcatcttgatggatagttcaaaagggtaaagacttagacaaaataatgagaaagggactatttggcgacatatttcatcctctccatcccactctgtggcttcctccctttgatgcacacataatttcaggaacccagagtgcaggattggtagaaacggaataaatatatagtctgttgtatgggaacaggctcagaagcctataaaagattcaactcctgctttcccttaggagaggtacccaaccagtattaatattttagaaatactggaaggtagaagaggagccattattcatcactggcaactctgtggtactaaaattaaataatggggttttttttaaagacagaattgtgaaagttgtgaaactataaaaaatattcctctcttggggatgttgcattttttgcttttatcttttcttcttctcttgagaacattttgatttactactgtgataagcttataacaactagggaacttgggagaaaagacgaggcaggctgggaggaggggtgttatggcagcttacaaatgggcccgggtacatttgcctggcttcaagtcagaaggtgctggagctgggcttggattcatttccattgtgtggcacacatatctcatgcatgggccagggacgtgccttgtgacagttagcacccacggtgccatgtgggcttgggatgtgagcatgcttgtctgctcagcaggaacttttcataaaaggtctagtcatccttttcctgaagcctggaaataatcagccctgctccttgaggagatgtctaagctgttaggactttgttatccaggagttggcatctgaccagcatctggagttttggattgatctggatgatttcagagtgttctgtacctgttcctccccctgaactagctgtgtaacccattggacaaatgacttcacctctctgggtctccttaactgcatttgtgaagttaaaaaaagcaatagaaaccaccaggtaaaatgcacacgtagctttagcacagtacgtggcctgcacaaggcctcagtgaatgcagttattacctaggatgccacttgaaaaacattttaaacccttttaatgataaaattactctccgtgactgttacatgttgtgtttcaatgcatactcatgagtgtcgttaacatttattgagtgcctactatgtgcctgccacggtacaatgtgctttagggatgcagttccattctgtcctcccgaggacctcaggaatgcaggtctattattcccaatcaacagaagggagaactgaggcttagaggggtgaaaagatttgcccaaggttaaaaccaagggcacattagagccagcgtacaaactgacccagaaatcattttctaaaccactgcaccacgggggcaggaatggtggctattgctcgggacctagagaaatgaaggcacagggaatgaagacgaatccttgctccacccatggggagacagtggctgggccagatttaagcagagatccctggacagcgcctcattccttacctgattcacacggtgctgatacgcttgttcagggctgcctcaagcttcagactcagagtcagaagggacctcagagtctatgtggtgctgatggtctttgtaacgccttaacaggatgagggtgtgagcctgggcgctgggtggcagccttgtccatcaccagatgagcttagcaccgtcggccaagttttcaaccccaggaagcctgcctccttttgagctgaaatctgtccattccatagcttgcatcgattggcttttctgaaagttaagactaaaccagtctccttttctgctggtctttagatgatacccaaaactgtacctcgtgttccatgtctctaagcattcaaccacttactgggttgggctgtgctcatcttacacagaacagatctcctcacttttctctcaaatgttttcctccttagtcccctgtctacacgtagcctctatccatccctgtatccttgtgggttagaattcaccacacaacatgatctcattaggagtcatcacctacaaagcaggtattgggcaattgtgtttacccagggtcgttttggggaatattagtaaccgaaacttgagaggaacttaaatctacatataccacccaccaaagacttgcatggatggtgcagtttccgaaaaactttgccaaagcatttattgactcacagctactatgatcttctcttgttgagcttcccttagggaaaacaacaacaacaacatattttaggtagccagagcttcagaggaagagagatattcatccaagttgatctcattgtatccatgagcctgttaattttcagggagcaagattctctagtcttaaaaatgtgtgtgtgtgtgtgtgtgtgtgtgtgtgtgtgtgtgtgtgtgtgtgtgttattgggatcttttaactaggagaatcactcagaatgactctgttggaggataccagaatatctcttggaactcaagcccaagaagcagaactggtccttaccagaagttggcaagccattttgaaaccagggtagctgtgcctgttcattgatttatgcattcattttccttttttcctgaccatatggtctctcatttcagcttgtcttagcatagcttctttatttattaaaaaatatttgagtttctactatggaccatgcactgttcacagcagagaacaaaatgaaaattcctgctagcacagtttatatttaaatggtaaatagagacaacagatataaatatgtcaggaagtatgtcaggtactgagggttcggtgaagaaaaataagacaaggatgatgctggaaggaaaggcactactttctttcaataaggtggccagggaagtcctctgcaaagagatgagtataaattgagatttctgtagcaacaatgtaatgagccacaggagacccatgtggtaaggtcctggcgaattcaagccattaccagacaccactgggaaagggggctgggatacttcagtgtcagagcataatttgggaccaaggctgaggaataagattgagtaacgttggctgggcacggtggctcacgcctgtaatcccagcactttgggaggctgaggcgggcaggtcacgaggtcaggagatcgagaccatcccggctaacatggtgaaaccccgtctctaataaaaaaaaattaaaaaaaaaaaaaacacaaaaaattagccgggcgtggtagcgggtgcctgtagtcccagctacttgggaggctgagacaagaatggcgtgaacccggaaggcagagcttccagtgagctgagatcacgcaactgcactccagcctaggcaacagagcgagactctgtctcaaaaataaataaaaaagattgagtaatgtcagagaagattatttaccagctgtagggtggtgtcaccatgtttgagcctgcatgggattcatttacacaagcattaagaactctatttcagttttccctgtaggctgttttctttgccaaggtctctgctaatggccccatagtgtcccctgaaaatggcggactcgactttcaagctggtaagacttcaaaggtcctcagtctctccctgtcccaatcccaggcttccgaaagaaatgatcttgccaggctcagctttggataggacgctctgggtcacaaagggcagcccgggactgacatagtgctaggcccaagcatggcgcttttggggaaaacggctgcaaaataggatgaggggatgtggacaaactcagcaaaagttgatgctgaagacagaggcagggatatggctataaagagccttgctttcctgaggggacttgaatttttcctgaaatcaatggggtggggggccctggaaagattttaatcagggcatgatccaattggaagagacagtagcggcttcacagagtgagaaacctcaaagctgtctacacatccttccaatgaaggcacatgcaaggcagaacagaatgtcaggatttcggatgaaaatcatggaaattttatttatttttgatactatttacatttccaggcatcagtcttcatgttaaaatttgtcctgaatgataagaataataagagtaagtgttaaaactctcagggaaagggcagtcaacgtgaatttccagccagaaagtcttcagttgttcatgttgattactagcaaatgggaatagtgccaggttcataatgctgattttattacattactttctctgaactctggtttaaataagtgcgtaaatatttggtacagggagataaacattgagtacacatggacataaagacaggaaaaatagacactgaagactccagaagtggggagggatggggtagggcaagggctgaaaaacttccttttggggccaggtacagtggctcacgcctgtaatcccagtactttgggaggccaaggtgggaagatcacctgaggtcacaagttcgagaccagcctgaccaccatggagaaacccatctctactgaaaatacaaaattagccaggcatagtggtgcacgcctgtaatcttagctacttgggaggctgaggcaggagaattgcttgaacctggcaggtggaggttgtggtgagctgaggtcgcaccattgcactccagcctgggcaacaagagcaaaaccccgtctcaaaaaacaaacaaacaaaaacaccaaacaaacaaatttccttttgtgtactatgttcactatctgtgtgatgggataattagaagccaagacctcagagtcatgcaatatacccttgtaacaaacccacacatgtaccgccaaatctaaaataacatagtaaaataagatttaaaaataaggccaggtgtggtggctcacgcctgtaatcccagcactttcggaggccaaggcgggcggatcatgaggttaggagatcaagaccatcctggctaacatggtgaaaccccgtctctactaaaaatacaaaaaaattagccggctgtcgtggtgggtgcctgtagtcccagctacttgggaggctgaggcaggagaatggtgtgaacccgggaggcgccactgcattccagcctgggtgacagagtgagactccatctcaaaaaaaaaaaaaaaaaaaagatttaaaaataaaaaataaagcaaaatctatacactaataaaaaaatttggtttaacctttccctgggaacagtaatggtctgaaatgatggaaagaagaattgaacaactccagggaagtgaagtttggcaagttagcaagagagtaagcatgtatagttcaacagcatccgagggcatgattaatttattgtccttttagatggcagaatgcacacaaaacccttcaaattacaccattattatgacaaagctcagggggtgtgagaagttaaagatgttcctgccaagagtttgatgtacagaggaaacgggcaacccactggatacacataaatctggaaatcgagactttgaagtccctcgtcctggctctgccactgacatgggcctgagatgaatgttcctgggccatgaatggccatgtcacacggagttccgattgggagctcttccatcagtgtcgggctcaatgccttgttgggtctactgggttgagtgctcctacccaactcaggacacgcttatctgttgcccctatgaagtatgggtcaagaccatgggctctgggggatttggttccaatccaaaatctttatctagcagactttggcaaggtttgtgggactcagtttcctcctctgtaaaacagattattaccaatacctacctcatagaattgttgtgcctgtaaaatgctaagaatagcatgtgccggagtcagtgttcagtaaatggtagcagctgtcattgtcatcatcaccatcattttaaactgttgagcatatttatgtacctaagcatttcctatgtctcaggtcattcactcaccatgagcctttccattattttccattgtgcagaagacaggagtgaggctcagagaggccacacagctttctataagtccacgttgtccgtgagccctgaactgggatgcagatgcgtttttatgtgtctctaaaccctgctctgctaaatactgtgtgtgttaatcaggataggttaggctttggtgacaagaaaccccaaatttcagttgatcaaaaaaacaaaagcttgattaagctccatgccctcagaaggttaggtgggaactgtgttcctcgttgtcattgtcctttctttgggacccaggtccatgaagtcactacaatttggaacattgctggtcaccatgaggaaggaaaagggaatgtatctaggcacactagagttcctaatgctttcgcccacaattaactgaagtgacacatatcactttcacttacacttcactagctaacgcaagtcccatggccacatccaggtccaaatggccaaggaagaacactgctgtgtgcccagaaggataggagcccacaggggctgaggcagccaccatgattactttctgataccataaatctgatctgtgaatagaagagatgggaggtacaggagatccagggttttcaccagagattccaggagccaccttgacttaaagcagaacaaccaaaggcaaagccaaggagagtgttttcaaagggctcagtgatcaggagagtgaaacacacagcatgcattaagaaatcagaaattcagaaagagacacttacaaatacctagttattcactgggacaataagggatgtaaaattatggtactgattggcaatttggggggtttgggcccagcaaataaaatgcaatgattgaatgacccaaagatgactcctcctcctccaatctgctgaggcatctttcagcgcatctcccatgttatgtaaaatgaggttcatagagtttattgagcagtggtcccttgaaggccatgagtactctggaagtcagaaatgatcaataagtattttgaatgcaagaaaagaagttgaggggagatcatatgttacaagaaatggtgcccaagaggaaaaccttttttttttttttttttttgagacaaagtcttgctctgttgccaggctggagtgcagtgacgtgatcttggctcactgcaacctccacctcctgatttcaagcgattcccctgcctcagcctcccaagtagctggggctacaagtgtgcaccaccacacccagttaattttttatattttactagagacggggtttcattatgttggccaggatggtctctatctcctgaccttgtgatccacccgtctcggcatcccaaagtgttaggattataggtgtgagccacggtgcccggccaaaggaaaacatcttattcaaaatcatgagagagaaactgaccatgaggctgagcgaatgtcagtgtaggttgggatatattattaacaggcatagactgagctcttacagtgagaacagccttgtgctggttacatatttcattacggggtggcctggtgtgctttgggaaggacaggcatgaaagggtgactcatacatggcctatgggtcctatgaggaaatttacctcaaccaggggaggaggactttcggcagcttttcccttctctctctgtctgcttcttaatatcacaaccatcttctcaaaaacaaacacaagtactgattgcctacgaagccctctggccgtgatttctctgacaatctcagaattcacctaagacttccctctgcaccatctcatgctatcttcatcttcatctcatgaaggttcatattgcagcttctcatgcacatctcatgtccccaggccaaggggctgggcatgagatccactgcacacctcctccagtgtcacccatgacgtgctgcaatggcagatccctgaggagctgtgccctggatctcatgcccagctccaagatcagcatgccaggcattctcacatgcacccgacagttttgtccttttaggaaaatgtcgagatacattcattcactagatgacaaatgtttgaggaatcactgtgtgccagaaactgggtttggctctgtgggataccagcgaatacaatcagacgtggccactgctcctaggaccacagagtctaatcagagagatggctcttaaaccacaagagttacataacatttcaacagttgtgttgtgtgggtgagctagaaaatttcaaaattatatactggaggaatttgacttggggggacccattattttctccaatcaagagaccaaggacactgaccagagtatttttctttacagagcctcctagtgcctacaattcacaaaagggccttgaccttctctgtgcattcaaaccacagtaggttaaacaaacaaacacattaagggaggactggataaaatcacctgtactcagactaaaatacttcggaatgtgacagatctggaaagcaacataaaagcaaggacatagaggatctgaatagtttaatcagttaatactagaaaagatagataaatatggaactatgtggcctacaaagagaaaatactattttttttaattgtggtaaaatgtacatggcagtggcattaagtacatccacattattgtgcaaccatcatccccatccatctccagaacgttttcatcttcctcaccttaaactctatacccattaaatgctaactccccattcactgcctctggaatcctctgttgcactttctgtctctattaatgttacaactccaggtgcctcttgtaagtggaatcagacaatatctgttcttctgtaactggcttatttcatttagcataatgtcctcaaagttcatttgtgttgcaataggtatcagcatctccttccttttaaagtctaaatagtatttctttatatttacacacatgtagacacatacaatctttacatatgtacacatataggtacacatacacttttttaaatccattcatctgttgatggacacctgagttgttcccacattttggctattgtgagaaatcctacagaatgcttattctttccgtgtgtctatgggtcacttagtaaagatgatattgcacctggccaataataagttttaaaataacattcaaaggtagaactgttattagccacattagtatataattatttggaaaaaaataaaacccctgcaaatacttagaaattaacaaatactctccttaaaaaaaaaaaaaaaagactgaagcctagtgaaaataaccagaaaaaagggcacactctcagaaaataatgcaaaaaacccaacaatgaacattgacttccttagagctcagtttaagttagacttaagcataatcttaagagtctgctatataagaaggaaaccagactggcaaaatgaccactaaaagatgaaggatctggatggtagattcagatcccctcattgtgtgttgctggagttttatttttcttcccaagtgctccatcttgcctgtaaccttagcgccttccctgggatgatgggagctccatttgaccttggtgatgaacacagacagccctaggtggcgtgagcactgctgattgataaggtgggtgtggagcttctgtccttctcagtggattgcgagaactttggctccatgtttcttcaccagggtatggggactcttggccatgagctttccttagttccctggctaatttatgacctagaggttgaacatggttgagcagcataagggtgagagaaaagcatggtactccagctacccagactgctgaatggctgtgtcttcaatttcaaaggcatggcaaggactaacccacagctgagaattaattaatgcttacagattaccttacagaagcaatctaatgataaaacacaaatgcctctgaacagctataggtaaaggcaacagtgtttttttttttcctatttaacgtagagtagaaaacatcttctaaattagcatatgcatgtaactccaataattcctcttacatgtttttaaaagttgtcttttcctgtgtaagtaatataggctcattttataaaactgaaaatattataaggtgaaggaaaaagtattacacctaccttcatcctctaaagaccagtgctgttcacatgtgatttgttcgctttggtagccaggaaggaaggtctaattatttcctagttttgcacccttgtgataataatgcatatgtatagttatcatcctctgaaaatgtgtcccttgattttctacatagaggaaaactaggcgcatcaatctggttggatgtgacagggaaagggtactagaatttatttatctagaagctgccttgcctcacaagcagtgttcacttggagggtctccatttaaagggacccctgcaaattataaggatagggagggtattaagtcccttttcaactcctaagcattaccactgcctgggaagttcactatggggatgttctgctgaacccctatcaactccagtgggggtggcagcaggttcaagatgccaaagaggagacctggagccagcgatgagacgaggggttttattggatgcttccatacaggggaatccagtggtggcaggctgaacaggagaaccacaaccacctgtaaaaggcatgcagtttatatagcattttcagttagcaccctttccctaacatccttcacctggcaactttcattccacctatgagtcagggcctggatctgccgtccatgttccatgggacaggccaggggttcagatgttcctcatagacaaggaaggagcctccaggtcggccactcccagatttcctagcttggaacagacatccgggtgcatcctccacacagagtcattttcagggtatgcataagttattgctatcaggtgcatttaccatgcaggggaattgtaaaaagagaaataaaggtctgaaaatgtgtctccaggtaaagtggctgcattttccaagaaaaagaaaaaggaggtttgtatgacagaccttatttttaatttgtgagtttatgaagcattttataatcatataaaaacaggcaaataaagttgtacttcttcactcagagtgttaatcaagtgtcttctatgttccaagccctgggaatgtgaaagagaataagaaagcaacagcctgagggacagttaccaccacccaccaagaggcaaggtgctcccctagctttaacagaccttgcaggcgaggagggctagagctcaggtggatgaggttaagtctgcatggagtgggcaggagaaagggtcaggggaaggttcagtgggtaagtaatcgccggcaccaagtccaggaagatgagggcatccccagcagagtaggtgggggatggccatccagctaaagaaaggcacagctcagagggctgtgcctcatgctgggttgtggcttcggactggagaagcaggtggagacccatcaaagaagagctctgagattttaccctctggcagagggagccattgcaagttttcatggggtgttttttgtttgtttgtttgagacagagtctcgctctgtcatccaggctagagtgcagtggtgtgatcttggctcactgcaacctctgcctcccgggttcaagcgattctcctgcctcagcctcccgagtaactgggactataggcgcctgccaccacgcctagctagtttttgtattttcagtagagacggggtctcaccatgttggccaagctggtcttgaactcctgacctcaggtgatccaccttcctcaacctcccaaagtgctgggattatgagcatgagccactgtgccaggccgattgcaagttttcatatgggtactgccccagtcagatgtgggtttgcattttagaatgaccattctggttgcaattaggacaggagatgggataaaagagaaatcagaaacatggaggccagggaagagactacttaatattcatttacgtattcattatgcaatgtttatttaaaagcccaccacgtacggcatactgttctaggctctgaggacaaagcagacaaagtagctacttgagatctgggttaaggagcagaggatagaggttggcagagtgtgggaggaggacaatgacttgcagaacttggcaactctgtcattctgatacttcaaattcattttctatacaaggaaaaaagagtaaccgattaaagtgcaattcaagaaagtgagaacctacagggaagtaccaaaatatacaacgaaacgccacagtcacacatggcagtgggggatcctggattggattttggattaaaaaaaaaaaaaggttactagaggccgggcgtggtggctcatgcttctaatccgagcactttgggaggccgaggcaggcagatcacaaggtcaggagattgagaccatcctggctaacacagtgaaaccctgtctctactaaaaatacaaaaattagctgggcgtggtggcacgcacctgtagtcccagctacttgggaggctgagtcaggagaattacttgaaaccaggaggcagaggttgcagtgagccaagatcacaccagtgcactccagcctgggtgacagagcaagattccatctcaaaaaaaaaaaaaaaaggtactagaaaaactgatgaaatctgaatacataaaatctggagtctagttaatagtcaagtatcagtgttaatttatcagttatgaccaatgttccatttttacgtaagatgtcaacattaggggaaattggatgaagggtacatgggaactctgtagtatctttgtaatagttctgtaaatctaaaattaccacccgaagtttataaatgaatacacacatatacacatacaaacctcaacctcaaccacattgagtagaaataattgtataattcatatataatgaccttatttatgtaaaaccactcaaagctgctatatagtctatgagttcatatgtatgcaaatacattaaaaacacacaccacattgtatcattcattacagctgagaatagaggtaggcatgggactttgcaggggaactgaatggaacattggctttgtccatattgtgtcacatctgtaaaaggcataccgtgagaacacccttaaaatcaaatcaaggagtcactacctgctccaggcctcagtactccctgcccctgcccggatgcagaagacactggtcccagctatgcgacgcccacctcccccccccaaacagccagccaggaagtctctttacccaggtatgaggcaagactcctgtgtgctatttacatgcccttccagagtgttgacaccaggggctcatgttctttctcatccttagctattttttccattccaactcagaggacaagaaaaaaaaacatcccactgtgaaaagaagtgtggaattacaaagaataataggaagttctcgctaactgtgaagccctgctatggagtatataatgggccttaacagctgctgcaacagtcgagactcgtggcagggtttgctttggccagaggagtgcactggatttcttatatttcttgacattaaacaacaacaaagggctgcaggctcagctgctgcagctgtggagttcccaggagttgagcacagcataatcaaggtggtctggaaacacacttgatttgcatggagtggttttgaagcatggctgagtgtatccttgggttatggtcattgcatacctcccatcccccagttcgtgaagttggaatatgctggggtccctctgaaaacccagctaggcaccaagaagccagagaggtggtgggtaattcagaagggcttgagcttcctcctggatctaaactaagccaagacactgagctttcccctgaagagggactttccccactccactttcatgctttcctcgccaagcttcctccaagccatggggtgcctttaacacacgtagagatgttgcatctagtgactttaagaaaaaccaactctgctttctgaggtcttagaaacaggtttttaaaagacttcctgttagtgttatatgtttaaaataggtctagaaagaaggtggcaaacagacccagcctatttttagcagagggctccaaacagtagcggtggaaaccagcatcagtgatactcaacagggatggtgctgaaagctgcccaaagcagtggtcttcaaacttgggtatgcgtgagaatcacctggggaggggggattgttaaagctcagattgccagcaattctccccctaccctgatttctgatacaagaggcttgggggaagcctgggaatttgcgtttttaatgagttcccagtgatgctgatactgttccagtgaatcatatcttgagaccaattagtctagagaaagcaaggcccctactggaagtgacacccaccatttccctgtgctggtggtcccatagggcctctcactctgggaacaccattcttggctgtgggtgtttcttcaaagtgaacatagctctgaggagcaggaggcaggttcagcagccacatccttaagaacataaaaagttgaagagagacagaagagagacagacgtgtgcagtgctaagctggggccctcacaatggggactggcttctttcctggggaataagtaatttcaattcagcagcaggagccaactcagctaggtcctgcctctaagacctttgtgtctgtaccaccaagtggctcaagctctctgagagagggcaagaaaatgactgagacccacccttggcagcagaagggaaagtcaccctgggataatttctgggtctagaattcagctttctgtgccgagtggcaggcagagaaacgggagggtggtgatgtttgtcccaagaggcccattcccccaccccctccttgtttcttctagaaggtctgggtgctgtgttcccaactttttctgagcagagaagggtcaagaaaagataactaacagcccggaaggcttttcctggcaggtcttcaccagcggggcctgtgtctggcagatagatgggtcagagaagcccattcttgggaagcatgattgcttcatagctcttgtagaattcccatgttcgttgctcgtcagaatgcattgtatgttaatagaatcttcaaaaaggacctgctcatctcaggtgtgcttaggagaacaagaggaaggagttttaatccatatttgggcaaaggtggtaatgagaggtgaagccagctggacttcctgggtggagtggggacttgcagaacttttcttagaagaggatggtaaaatgcaccaatcagcactctgtagctaggattgtaaaatgcaccaatcagtgctctgtagctacctagaggtttgtaaaatgcaccaatcagtgctctgtaaaaacgcaccaatctgcactctgtggctcgctagaggtttgtaaaatggaccaatcagcactctgtaaagtgggccaatcagcactctgtaaaatagaccaatcagcaggacatgggtggggacaaataagggaataaaagctggccacccccaaggcagcagcgacaacctgctcggatccccttccacaccgtggaagctttgttctttcgctcttcacagtaaatactgctgctggcagagaggggtgaagcaataatgaccacagtgacagagaagaggtgagtgtgcttggtgaccccttcccacgcagggagctgtttccagagcacttctcttctgggaggcctgtgaattttgttattaaaaaggaaacctaggccggacgtggtggctcacacctgtaatcccagcactttgggaggctgaggcgggtggatcacatcaggtaaggagttcgagattagcgtggccaacatggggaaaacccatctctactaaaaatataaaaattagccaggcatggtggcgtgtgcctgtagttccacctacttagggggctgaggtgggagaatcacttgaacctgggaggcggaggttgcagtgagccgaaattgcaccactgcattccagcctgggtgacagagtgagactctgtctcaaaaaaaaaaaaaaaaaaaaaaagaggaaaccacctattccctcagaaaaggatagagataccattcttacccattaacaacagtgtaattttattgtgatgattaatattggaattattagctttgattaactgagctccttctgtgtggcaggacatgtactttatagatgccatctcattaaaccctcggcaatgctgggaagtaagtggtgtcatctgcactttaaagatgaggcgatggaccgtgttcatactcacacagtggatcactgggaaagctaggattgcaacatatagctgtctaatccgtggagttcattctcgctacttgccagccacagggatccaatggtgagcccagtaagctgtggctcttgacctcatggggcttccaggcagcaagtagaggggtcagtggaaaagtatcagttggattaatcaagtcaagcaatgactgaaaattattttcatcagagagtatcaaacacctctttttttttttttttttttttgagatggagtcttactctgtcactcaggctagagtgcagtggagcaatcccagctcactgcaacctatgcctcccagattcaagcgattctgctgcctcagcctccagagtaacagggattacaggtgtgcgccatcacgcccagctaaattttctgtagtttttgtagagacggagtttcaccatgttggccaggctggtcttgaattcctgacctcaagtgatccgcccaccttggcctctcaaagtgctgggattacaggcatgagccaccacgcccggcccacatagtttatttttaattttcttttgtatccaattttcagttactcttaaaaatacaaacatatgtaattggtgtttagtcaacactcagtgtattttaataaacaacattttttaatcggaaaaaaaaaaaacctgtaatgccttgagtgatcctgccagatgaaccctggcgtaaagttcatgctgccttaggcaccattgccacctggtgtcagacatcggaattgcaggcttggcggcagctaaagtggcgggggtggtggggtggtggagcagggggcgggcaggacccattttgattaggagagggcaggtttcctgtcttagccacctaaaccctccaggcgctgttgagtatgtgtcaacaggtgcctgttcgtttgtaatttggtgacagctagatctgtatcagctttcttttatctgtgtgtcctgaatgattattgtgttcatgacctttcaattgttttgttataatcaaattaacgtttgaaggttctgatgataaagtgacataaatatagatgaatacttgagggtaaactctagattccacttatgccaataatagttctctttagttgcacatctacataaaaagaccaccccccatactttgaccccaactgcttctcagcctaaccctctacatgcttaagcatatgccagtaactcacgatttgcaaaactttccagactcttccttgtctgcctgctgcctttgtctgtgctgttccctctgcctggaactactctcctccacctttcccttccaaatttattcttcaaatgtcaaatcaaggtcgacaatttgtaggaaaattccataaagtaaattcagaaacgacagtgttgtatgttgtattgcagtgtctctagagaatggaagatgtggttctgaacccatttttatctctttcatagctttggccatggccagcttgctgactcattctatctcagtggtttcatccattaagtggaaataataatgtcctctgcctccagcattgaaatatatatatatatatatatatatatatatatatatatatatatatacacaaccctaatttgaggtttatatataacatatatattttatttattatatatatttaatacatagggatttaatatatgtaatatttaatatatataatggggtttaatatatataatatgtagggtttaatatatatattaatatataatacataggggtttaatatatataatacataggggtttaatatatatattatatatcatatttaggggtttcacatatataaaacccctaaattgaggtatctatatataatattgatgcatatatatttaatatataggggtttgatatatataatatttaggggttatatacatattatatatataagccccctaaatagatgtgtgtatgtgtatatatgtgtatatatgtatatgtataaaccttttctgatgagacaaagtgcttcctctgcaccatgcctagtacctagtagaagtgacagggcaggtgacactggattagtggatatatgtaaatacctggaatcttgatcaatgcatgcgcagcaaatggcttccattaccttttttgttttgtttgcagataaatatttttttgaaaaaaatatatttcgtggagttaaaaataataaaatgtccaactttgactgaactggcattattgccctccttgatccatcactgtatgtcacccgagtgctggtaagcttcctcagctgccagctgcaaagacgtggatattaggatgaaaggcgttaggcagtgatgctatttctggtgctgttactttagtcaaatctgtgttcaccaggtacccatgtgctggcacctgtgattagtgaattgctcatgggagtatgtttgcaatgtgctttctctgtgttttccaggcagttttaaatgtctctctgtttttctgactaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaagtgagtacccctctcccatgcccaccctgtgcgcagaaatgtggctttcaaagattgttttcttcccactgagctcattatttctgtgcctcatcaaacccgggactgcatggctttagggtgtttctgtgggagctgaagtggatggaattgaaccctgacagggcaacagtggggggtctttatctcatcagtagagccctccaggcctgcatcagactttgggtaccagagaccaagaagggagaccctgggggcatctcagaggaggtcagaacccttagggcaactttggctttccagagaccagcttgatgatctagagctggaagaggtataaaccccaagacctgatataattagcaagacatggtccttagggtgaaaacagttgctaaatattcagccataaaggagtagttaaattatggcagattttgcaaggcagttttctctagccatttaaaatgcttctgaagaagttgtgttatatgggagagattcaagatattgaatgaaaacaacatacagacacatatggtatcctcattaccaatggagtatttgcacatatcatgaggtgtatatgtttaacaaaaatgataaagaaaaatcagtgggttaatggttgtatttggaagtgattgattgattgattgatttggttttcttacctacttaaatgcattattgtgagtttgaagtgagaagatactataagggcgttggaggcataaagtgctggacagacatagagcagtagcatgatggtaggtagtaaagtccccaccctccagcagaacccttactgggcaatgcgctcaagggtctcaggccctgggaggatgcgggtgctttccagatgtccatctcggaagccttgccaaagccttttctgagcatttgctgggggagtcacctgtcaatgagaactgaaacgtgagccatgagtcccaacttatactcaagggggaatcaggtagttgtataaattgaatgttggtgacctcagaaatacccagttccagctggccttgacagtaaccagaggtgacctggcagctattggggtccagctcctgtaggaacaaccagcagcagactatggatagatgccctcttgtctttctgtgcccatcatgggagtctccaagaaagttctggcacaaaaaactaaggaaagatacaataaatttcataatttcttaacagagtgatcaagagctgtgggatctgatatggtttggctgtctccccaatctcatcttgaattgtagctctgagaattcacacgtgtcatgggagggacccagtgggaggtaattgagtcatgggggtgagtctttctcgtgctgttctcgtgatagtgaataagtctcatgagatctgatggttttatgaatgggagttcccctgcacatgctttcttgcccaccgtgtaagaagtccccttgttcttcctccatcttctgccatgattgtgaggcctccccagccatgtggaactgtgagttcattaaatctctgtcctttgtaaattacccagtcccgggtatgtcttcattagcagcatgagaacggactaatacagcatctgagatcctccattcaggtctcagtgctgctgcgtactgagctgtgggaccttgagcaacactcttaccctccctgatcttgggattcttgtccataaagtatgattacagctaacgcttctgaggattataaaaaatgaaattactagtttttgctaactagtaattgctaaacagctaataaaacagagcttcggttgcagcttggagcttcccatactttttaaaaactgaggccatataatattacggtagttaaaagcatggattctgcacacagccagattggctgcattcaaatcatggctatcatgtactaggtgtggaaacttgacaaattgtctgcctcaacttcttatcctggaaaatgggaaaaataataatgatgtcataggatttcataaggattaaatgagttaatacatatgaagcatttagaaaatgctggaaacatagtaagcatcatataatcttcctacatgggtgacaataatcaatgatattaaaggtgaaggaaggtaagtgaaaacccaaaggattccaagttatagcccaatctctcatgtccagcacaaactttccttgagtagtcttgagtttttactatacttttatagtctatgtcatagcatatggattgattgagcaattcattcattttacatacatttaattgagtgcttatagggtaagggacacgcttcaaggtgttcggaggatacagtagcaacaagacacactgggttccttgctttcatgtatcttttattctagttctttgtttcggaataaactggcttgaattcctctcttctgtgtgtaggtgacatggcaggaagttgtgcctggtttgtaacatggcttgttgataacaccagcacagggtcatataccctcattggaaagggtactggtatttagtgggaatgcagtttcttacacaagtacttgggttacttacgactggcagactggggcccagcccttggcagcgcactcttcaatgggctcatgagggcctactttctgatgccgtttccctccgtgcttcatgcacttcagttcggtcattgtcctgttttcatcatacccgcactgaagcttcttacagttgctgaagcttcttccttgaagaagcaagtttgaggaagagccccgatcattctgcggttctttatttttagatgatgagaactgggttactctcatgttggtctactttgggcacaggaatgttgcaatttccgttcattccaagtgcctgtttaagaataagttactattttagtagtacagctagatccatggtattcatggtagtcaacacggttgggagcaaatgtggttcttcaaagaggagaatcctgggtctccaaatcctcacattttagtttctagtcttgcaagtttaaaaaggagagagccgggtgcagcacaccaacatggctcatgtatacatatgtaacaaacctgtacgttgtgcacatgtaccatagaacttaaagtgtaataataataaaaaataataaataaataaaaataaaaatagaaaaacagagcaagaaaaaaaaagaaaaagaaaaaaaaaaaaggagagagcctgcaggtgaatgtgttgtcatcataatagcgccaatgtttctgttgtttaaagttaagtgctgctcacatgcaagtacgtgttgatgtattaacgttttccaaatccaacaagaaatattttgatctaaacctcagggatttgtatgataagaaataatctggaatacatttgtccttgggcccctgaaagtgcatcaccattgaagctcctgtttattgaacactgcatggcagatattatgctaaacactttgtataattctcttatttaatccatttcacacaagagacttaagaagtaggtgttaacaccatttcacagataagcaaatagctgttaaacaactttttcaaggtctcacagctggcatgtattggatttgggatccatatccatttcttttcagctccaaagccccacattttcaatcactaagaaacactcttcctattttatccccagctagattttatatctaatctgcaaattccttagctcctttcctaggaactctgcttaccggggctgggaagggagtttggctggctgggtgatctattactttttaaaaaccatccatttccgtgacccactgccatcttgccactcctccctgccccagcccccagaaaaacttccccagcttctgacccaaagtagcacctggcaaaataatttatctcttgcagtattggaagctgacatactaatgcaaagcctcctgaaatattactcattattatgcattttgccagcatttgagtgatatgtgaactcttcactggaataaagtactgtaaatgattcatgaatgaccaagtttatgaaattctataaaaatattagcaggtggtaatgattccctcacactgtgaatatgatctactggctgcaaatttgccaatatgggatgacgggagtggagtgggagaccatctgttaggcgagtgggggaggaagacggtgggggggcggttgggatgggctctgcaggaggtgcagggcaaaacaggaagcatggccaagaccatggtagcaggcaggtgtccttggcaggagaccttcacactgatctgttgtccagtgggagatgctcagataactgggaatgtcagagctgggtgggagaagagaggagcatatggaagaagaggcaaaactaactttattgagcatctattaagtgcccaagaattccctagatccctgacatacacagacctatgaaaatggttatcttgtcttcactgatgaattagatgagggctaaacaggttcccaagatgtatttttactattaatgttggggtgaacatgtcttgaacatttacagtgtgccaaggctccatgccaaatactcagatgatggtctcatctcatcttcataaagataaccttgatacgtctatcacactcaattctagaacaggtaactggaaccacctgtgttcctggcctcagaacatggaaaggacctcactgccaccttctgagtatttgctcacatttcatactatataacttgttcttttttgagccaatttcttggtcaagttttgaatttgtggtcaagaatgttgtcataaaattgaaatacaactggcattcagaggtatccttgctcatatattttcttttgttaatgtggctctacccctattctaacccatctgtagctccatgacaatttggcagaatacacattaaagtgaaagctgctgccgtcatgcggaaataggtgtatcataatgtcagtgcttataagacgattgggagatatagatgtacccatattagagagttatttaagtgattaacctggttataaaaacgttcatgttatgaacaaatgatgcacatattaccttgatgggattgtactacacctgattagacttgtacttggaaaggaccccagccctcactagtagggacatgctatgtaagtcttctttgtcctctactctggtctcccccattgctacctttcttagccagggttcttggtggcagtcaacaaaatcacctccaactagtttacaaaggaagagatttattaaagagtacaggtagccattaggattgcccaaagtgccaagtaacctagctgacaaggccagatgaggtggtgctacaggaaatacccacatatgaaactattctagggcaaggtttttcaacagtggcactattgaaatttgaggctgggtgattctttgttatggggggctgtcctgtgaattgtaggaggcttagcagcaccaatggcctctacccactagatgccagtaccaccaccccccacccacacacacacctaatctggacaatcagatatgtctgctgatattgccagttgtcctataaggggcaaaattgagaaccactgttagagagaagtgtcatagtccattttgtactgctgtaacaaaatatcggagcctgggtatttataaagaagagaatcgtattggctgtcatttctagaggatggacaatccaaggtcaagacaccagtaggtttggtgtcttgtaaggccattctcttcttgcaatatggtgcctggcaccttgcaccctccagaagacaggaaggctgaattctcatatggcagaaagtggaagggccaaaagacagcacctattcctgaaagccttttaaattaaggcatcaaacctacccatgagggtggaacacgcatgctctaatcacctctaaagggccccacctcccagcaccattacattggctattacattacaacaagagttttggaggtgacaggcatttcaaccatagcaaagagtcaaggtcgctgctggctcttcctgccactttgctctgatgctcacaactggatgtggcagccctgcttgggttacctaaaagagccaggtgactttgccaagctcagaacctctgatctgcaaagcacagctgtggcctcccgccactcacttccatccagtctcacgctggtgcatctgcaggaagaacctagaccgtaagcaggactctaggtgcaagagagctgggtcaacatagtttttagtttttccagctccctggtacaggaaagtccgcttgccagaggactggagtggtggttgtcatctaccacattgtgatgacatgagtgcaatttttttaattccatgggtttttggggaacaggtggcgtttggttgcatgagtaagttctttagtggtggtttgtaagattttgctgcacccatcacacgagcagtatacactgaacccagtttgtagccttttattcctcattcccttcccactcttcccccttgccaagtccccaaagtccattgtatcattcttttgcctttgcatcctcacaacttagctcctaattatgagtgagaacatatgatgtttggttttccattcctgagttacttcacttagaataatagtcttcaatcccatccaggttgttgcaaatgccattaattcactccttttgacggctgagtactattctaccatatatatatgtatgtatacacacaccacagtttctttattcactcattgattgatgggcatttgggctggtttcatatttttgcaattgcgaattgagctgctataaacatgtgtgtgcaagtatctttttcgtataatgacttcttttcctctgtgtagatactcagtagtgggactgctggagtgcagttttgttccaagtgagagcctgtcagtgagaagcttagttgcccaaaggcaggtaacaggcttacacctaggagactgtgttctcaaacctgtgatcttcacttctgtcatcattagggtcctatcaatcaataacacacatgtgacctaggcaagagccctgagtgggacaaaacaaaggatttgggttaaaagcccaggctttggagccagacctacggagggaagaatctcgactctcctatcacgtgaaccatatgaaattgccattcttacaggtgaaaaagaggtgaacattggcaatttcatggttcattctaatactctgacacctttagccagttacttctcagcctctgttttctcatttttagaatgagagtgagattacagtatcatctcctaacagtgttatcattagtgggtgtttatcactcagcccagtcacttagtaagtgttccggaattgggagccagcctgccacatatcggttttatagtttaagctccctgcaagtacaatggagttgaaagcacttgtgagggagcagctagcaggtaaacagttgaatgtcagtaactctctgtaaaagggaatcatctcactgggcagtttcaaactgtggccccagactaacagcgtcacctgggaacttgttagagatgtaaattgttaggtgctttcccaggcctgctggatcagaaactctcggggtgggtctctccatctgggttttagccagcccaccaggtcatcctgacgctcactgtagttggaggaacacaggtctaaataatcacactcttgggtattaacatcatggcagctgacctgatcactaattggccttgatgaagatgacctttgaacctgtttcgttacagttctggtggggtaacatgtgcctcaactgtgcttatttctcctggtgctccggtgtgccatttgaaagccctctccatccaattccaactcttccaaactgctttctttttgtttcattagtggcacctgagagccaggcaaatttgtcccaggcttccttgctgcatcctgcctagactttggatgactgttaaatgccatgttactgcgtgtttgcttgtttctcagccagagatgaagatgtcctcagaagattggagttggaacaggctgatgtaattcctgataggggaaattagccttggggtcggcagaaccagctttatctgccttagtagatctgtgaccttgaacaaagcatttgtggttcttgaactttgttgcccttagaatcatctggggagctttgaaaaccctgaatgcccaagctgcactccaaaccaattaaatcaggatgtctcagagtgtgaccaggtgtcagtatgtttataaaattctccaagtttttccattgtgaagccaagtttgagaaactgttgtgttactataacttgtctgtaccccagttcgttcataattaggaattaatataatgataccaaccagctaggtgtgtgtttgaatatcaagcgagacaatgcaggggtttctaacacaaaataaaagtcaaagatctcatttctcccaactgcttcactctgagcaaacatctgaggctgctttctaatgcctccttggacacaaacacttaaaaataggaattctgagaaacagaatttaataaacaaacgcttgtcttctgagtgcttgtgaaaaaataattcgaggtttgttcacagcccctccctacccctgcacctctgatcacctccacctgactttttccagttcgtctcttcgtatttccaagcacttcattttattacaacccggccttatctgtcaggtgcagctggcgaaactgaggcatgaagaggttaaacgaccttgtggaggcagctacatacctggattagactgctgagttgcttctgactgattatttatttggtccactaagcaaagctgcttcctcactcagggctatggaaacatatttttctctgaacttcattagcacaaactcctcagaagaggttcaacttgaatcttggcaggtgggagaaccccacattccttaattttctcttctccacccccacactggtctttgcacctgtggcacctggcccacactcggtacttagcacacatccatggaatgaataaatgacaggatggctacccttttttttctgttttagttgtctaactacaaccaggtctacttcatcatgctgattcttcaaattacttggcggcattttctttcccaaggtgcggaagcatcgcaatacattgggactgcaagagccttagacccattttgtccagcccagcagcccagcgaatttacagggaacaagttaaataacggggcaactgctcagactcccaggacttgagattccctggctatgacgagcattgtgagtgacactctgggaccagatccccaaatgcaggggcacggtgggggaccatccattccagctcccgccacccattagccatctatatgccttcagctatcagcataaagatatttatttttatttggtaaaaatgagaagggagaggaagaagaagtgcattagtggtgtggactggaagacagaggagcgaaagaggggatacggacaggttgtcctcctacgctgggaccctgaagtgtgttgaagacccttgggttcgagaacagaaaatgattgaagtcatgttttacgaaagactgcaagattgaaagtgaaggccagaagctaattaaattgatcacaaacgattgggtcagaacccggatgcaagcaccacagctatgggaacaggtggccaaggattacacagttggaaagagaggccccctctgacacctgtagcactgtggcatgggaagtgctggtcttcaggggtgggtcaccgtggtgacatctcccgcagtggtcctgataagggaggaggcagcagcagttggcacatggtatggaagctgacattgatcagggggcccttgtgaagccagccttgggcctcccaggaaatacctggggaataatgttgtgatgggggctgagttcctgtggagcaggttggaagctggtggtgcctatgatcagggaataaaggcaaatgtgtcccatgtcgtcatgcaatgctgggaagccagccaacctccgtgttacccatctcgattctggcctgcccactgcttcctgtttaattgaagcagatgcgtgactgctctggatatgaaatacggataacctgtgagcaaaacccccaggtaaaaagcacgtgggggagcatgctttttggccagctgagtcttctcttccagtctagagaagtggaggaaaacaggggagcatctggggaccatagagccagcgtccacgccaggcagtgcagactcggcagctccatcagaaagggattcagctcaacctgggggccgattcattcaaaggacattgatctggcacccaacttgtgttagccactatttcacagtgctggggatacagcagcaaacaaccaccaaatccctgcttcatggagctctgtcaatctacaggcattagtgagtatgtgacgatcaggtggccctaagtgctgggaatagacacggagccgataaaagatatagggtggtgggagacactgcttggtccaggaaggccctcctgggaggggccgtgagaagggaggccagatggaaagtctcctgagggcaggaatgagtgctgtccttatctctcatgtacccctgacagcttttctcaaccatggatgcttcagtcccctagcagatgcctggcagtgtctgcatatgtttttagttgtcacaactggggctgttattgccatctggtgggtcaggcatgctgctccacatcctgctgtgcacaggacagtccccacacgtccgcagggccgtgctctgcaggctccttgcatggcgttggccactcagagggtctaaaattattgcatggtttgtttgctcagtattcatcaggtttggatagtcaagaagtctgtcttcatctctggggcaccagagatgaaggaagggacactatcactgttcttgtaaagtccacacgctagctggggcaatgatttgcaacaatcgactatattatcttgtgaggagggtcatgttacaggttcagccttcggaaggacatgaggtcaaagcaaattctcaagaatgaggaatgacaggagacagagacgcggacggggcaggaagggttttgtgagaacagctgatggaagaaagcatttaatggcacctccagcggagtgcgtgcagtttagagcagacgagggtggggccatggcagggcttgactaggagcaaaggtgggactcgcatgctaaggagtgagcttagacatgatactcctgcggcgaaagggacaaatgatggaggattttaggctgaaagtgacatgatcagatttggattttacagggactgatccggttgacatgcaggggatgaatgggagacagtgagttctgtctctgggtctttgaagccagagtgacacacatcagatagatgcagttttcacccaagaagacctgggtagtgaatgggattagtccaaactcatagtgaagatattaaatataccttgggatgaaaagagtagcaggaatgcggacttgtgggaggagggcaggccataccgggcctcacagggcaggataaggtgcttggattttactctaaggaagcctcagcctcagagggttctcaggaagggagtgacatccaatttgcatttcaagaagataagatttatttgagcaagtcaacaataacattcaaattgtcatgaaatagaaattaattcaaaaatgcattcatttattgaggccccactaccaggcactggggaaaagagatcaaagagaaaactttgctttccctggagctctgccttcaagtttccctctacacatagcaaaccagaaaacctttattttttaattcacaagtagagggttggggagcattttatgcactgactcgttctccccatttagtctggcataatttccatgccaagtaaatattctctcttaaaattttaaattttgagggttttttttttcttctacgggggtttatcagtgggctctctcaaaatttattaaacacagttggccagagctgttagctgttgatttctttgattggtatctgttttaagatctttattatccagaaggcgtatcttttctcccagtgaggcattaggtagtaaaagagatcatttccgtatttttctttcttccaaaggtgcagatgtttgcataataggctcctttaagtaaaatccaccttttctggaatcatgttggaaagcctgcaggcccacgatgagggactatcttatattctttaactcaggaatcctcgttcctgtttctgcatgtgggaccaaactgagccatgttcagtgtgccagaccaaacactctgaagctggactagagtaatagcaaactggagagtcgcatcctcgttaaatgatggcttagcatgtaaaacattcgtgtgactggatagtcagtgtttgacaataagatgctgggaggagagccctgtgctcttttgaaattgattgtgtcctccttcaatggatcattaatagttggggaatccacatttaaaaggggtagacccacagcagaggtcttggtcagaggtcagaaaggctgagaaaaatgggcagctggcatttcacaattagtcgtgaatgcattttctattcctttcgagtttttattgcagaacctaatcatgaactccaccaaagtcacattagttcctgttcagtgtttcttatctcctgtgatgtgaggctctggtaattagcagggctgtttctgctcccaaataaaaaggagatatatttagaaaatggatgtgttaacccgggaaagcaggcacaggaagggctgcatgaagtatctttctcttggtgaggtaggctgcaagttgatgtggaagaagttctagatcatactgtgtgttccctgcctgaccacccccgcaagcctcttgactccctattcccaaatctggaattatttttagaaagctgtcccaggccggcacggtggctcacacctgtaatcccagcactttgggaggccgaggctggaagatcacctgaggtcaggagtttgagaccaacctggcaagagtggccaaaaccccatctctactaaaaacacaaaaattagctgggcgtggtggcaagcgcctgtagtcccagctacttgggaggctgaggcaggagaatcgtttgaacccaggaggtggaggtagtggtgagccaagatcatgccattgctctccagtctggtgacagagcgagactctgtctcaaagttatcccagaggatatcaaactgagaagacaagtatttcttgggaatgccacaatgtggatgacataattttgggtcagcccaggaaatctgggccctaagatagaaagaaaggaaaactgtgaattctgtatttggaatgtgaaccaagcatatgccgggagacatcctcgaaataccatttccattcagaatggttgctccctttgtccacatgccttcatcttcctcgggctctgaccttcgcccagctctctaaacttgagcaaatgctcagagcaagacctggtgctaggatcggaacagggaagacacatggaaatgaataaggtcacattctagataacttgcacatcacggccccatttttgtaataatccctttctccatcctccacccctatcctcacttccctcttctctatgaagaattcagtttaactgtgtaggttggatcatggcatgccggtaccctggggtgatggagagttgccttcctactgaaggtcagctactgaaagagcatctgtgcgttggcaaatctgctaggttcagggctctccgagggaatagataggagaaaaattttggattcacctttgattgtacttcctgatggagtcaggattggggtgaggagaattgcacgttaacaagcatagattgcacatggagtggctgtcctttgaggtagtgagtcccctcatggttgatgtgttccagcaggagctggtgagcaccttcaggaagagcacagagggattgttactttatgtagttacattagaagtagggggtctgcaaactgtggcctgcaggcccactccattttcacccactcattgcatattgtctgtggcctcttccaccctgcagctgcagagttgaatagttgtcagagtgtggcctgcaaagccaaaaggacttactctgcccctctacagaaaaagcctgccaaccccggactagatgaaccctggtatgggttggatgtttgtcccctccacatcttatattgaaatgcgacccccagcactggaggtggggcctggtgggaggtgattgaatcatgggggtggacccctcctgaatggttcagtgtcatccccttggcgaccgagttcttgctcagctatttcacatgagatcaggatgtttataaaagaatgtgacacagaaacagaaaaccaaataccacatgttctaacttataagtgggagctaaacaatgagaacacatggacacaaggcgggcttttcagagggtagagggtaggagaagggagaggatcaggaaacataactaatgggtgctaggcttaatacctgattgatgaaataatgtttacaacaaacccccatgacacaagtttgcctgtgtaacaagcctgcccttgtacccttgaaattaaaagtgttttcttttttttttttttttttaaaaaaaaaaaaaaaggctgggcacggtggctcatgcctgtaatctgagtgccttgggaagctgaggcgagcagatcacttgaggtcaggagttcaagaccaacctggccaacatggcgaagccctgtctctactaaaaaaacaaaaattagccaggcatgatggcgcatgcctgtaatcccagctactagggaggctgaggcaggagaatcgcttgaacctgggaggcagaagttgcagtgagccaagattgcgccagctgcactccagcctgggcaacagcaggactctgtctcaaaaaacgacaacaacaacaacaaacaaacaaaaaaaaaaaaaagtgtggcacctcccttcccccacacactttgctcttgcctttgccatgttatacgcctgcatcccctttgccttccaccatgattgtaagtttcctgagtcctccccagaagctgagcagatgccagcatcatgcttcctatacagcctgcagaaccgtgaaccaattaaacctgtctcttttataaatgacccactctcgggtatttttttatagcaatgcaagaacaacctaacacaaaccctcatatttaggaattgatagctccagcccttttatatctaattttaagagcttttgagactatcgtagtttatgccttaaaggaagcttataagtttccccttttctgggtatttccaaggaaaggcaaaaatgtgtcaccctgaaatgatgctgatgttgtctgacctagagatgaactaagtccagtctgggacaggctccccagggagcattttcatggaggtcagtgtgaacccccttttccagattggcggcagggccagctttaggtcccttgagattgtctgcatcccacttcctaagtaaacaaaataatgactagaaaagtcttttcaggaaagggaaaatgtgcaaatatacgagacaaaattgcttttctttcccagcagttttctcccttaggaccatttcacaggcctgagctaccctaggagtctgttttgcccacaggctatgcgtgaagccgacccttaccctctcacccagtgacgaccacgacaatgttgatgatcataagcagtgcttgcaggcttggctagtccttcacagatgctacgtcaccagtccttgtgctgactcaacgagtaggtggctgtattagttttctatttctgcccaaacaaattactgcaggcttggtggcttaaaacaacacaatttttatcttacagttgtttaggtcagaagtccgacatggttctcactgggctaaaaccaagctgtgggcagagctggcttcttctggaagggagcatcattctccgaccttttccaacttttgggggccacctgcattcttcagctcatgactgcttcctccatcctcaaagccagcaatggaagcagctcctttcacactgacatctttcctattctcccatccccagccctctttcctttataaggtcccttatgagtccattgggcccatctacataatccaggatcctttctttaatttaaatttatctagttcacaacattaatcttctttaccatgtaacctaacatagtcaaagtttccagacattaggaggtgggcatctctgggggccgctattctacctaccaccacactccttgtatagatgaggtaatggagagacagagtgggttaggaacttgttcaaggtcacacagtgctaagtgatggatgatcttaacctttgaccccagctattgtcatctttggaaagcagggatggataatgtggccagcacagtgtccaaggggttcccctcttctgctggcttcaaatagggtgacggccggaaggagaagtaactctggatgaacccccaggggcaaccctagattcttgctctgaaagctcataggcagtgtgtggcaacactggtgtctctgataggttttctttccagagtgggagtgccccagtcttttgcaaatcttccttttctcataaatgttacctaggtgctttgcggggatgattttcttcagaatgagtgagtgtcacaaaacagccggccacttgatttttattcctgtttggcacagtcctgggcacagagctcctttccattcgttgcttagcaagaagcaggccccaaataaccacctgccccaaggcccttttgtccactggagaggataggtgattagatggagggtaattgataacgcagggtcagtagggagagggaaaccccttgaggttggacctaggcagctccaagtccagattcctgctccagtgcaactgatgctaaacaacaacagctaggcttgactgagcaccgctggggttcaggtgtggcgtgagtgtgtttcctgaatgatcacttagaagttaagtctcccctgccatgccgggggcattgttctaggcacaagggattttagagtgaacaaaacacatttgtagccctacccccagcccctctggagcttatagtcctaaggaccttaaaggtaaagattgtttttgtccactttgcatgtggagaaactgagcttaggaaagtgtctggaaaaaggttacatggtagctgatagtgaaagaaccaaatgacaaacccacgtcctcccctccagagcccaagctccacacactgactctgttaactgcttggtttgggccgggcaccgtggctcacgcctgtaatcccagtgccttgggaggcctaagccagaggattgcttgaggccaggagttcaataccagcctgggcaacatagagattccatctctacaaagtaaacaaatagataaataaattagcacggtgtgatgttatgcacctataatcctagttacttgggaggctaaggtgggaggataacttgagcctgggagttcaaggctgcggtgaactatgattacataactgcattccagcctgggtaacagagtgagacccagtctcaaaaaagtacatacacacatatataaacaaacacttaggtttgcagggaagcaccctccaatgcacaggtcagcccctgccccagagaatgacgcaggtccgagtgccaatagtgtcactgcggagaagccccggtgtaaaatgaaaataataaaatccaccatagagcgttgctatgagttttgaaagccctattatgtgagccttcatctaaccgaatcatgttttcactgactggattttcagctggaatcgtggcatgtcagggctctgcctagccgggccccactcctaccccgacccaaaatctgagaaatgaccagtaacacggttctagaggaatttgccaatgctcattttttattctatgtggtggtgtttttttttttttttctcattgcagaagacaaattctatttccttactcctgagggaaaactaattccagcaaaggccatttgtctttggtaccttaagatctaggtaatttactgcaagtttatttttattgaaaattatgtagatattattcagaaacacaattttcaactatacggcacacttaagcacgttatattttaagtgttaatacatagactgaggatatatgctagaatgtgcatttctcaaagacacttttttcttttttgtcactcactgcattcgaggtccttaaacttgtgtgctatgaagtgctaaaggattaaaatattttcaaatggatattgtgctgtaagttttgagttgttaccatttgactgcaattgaaactcatgatgctttatatagcttagatgattaattcagaaataatttgcatttaaatgcgtttaagatatttaacttatgattccaaatgtgcctattttaagcctggtagaagtactttagtctccaaagtatgtggacgctctacttctccctagtttgtggacctgaaaaggatttagatattaatatagaataacttttccaaactagttctgaaaacataagaactgagagatagccccctgcaacacacacgcacatgcacacacacacacacacacacacacataggttttgtgctgtcttgggagcatttaagatactctgcaaactacaattgcttccttaaaatgtacagtggacgtttgacatagtaaagatattttgaagatttgcaggccagaaacctgtttaagccaacatattacacacttttaagaaagaaaagctcttaataacatcctataagaaaatcttaaccattatagaagttactctttgaataatattgtgagaaaaaatttaattagtgaaaccctaaggaagttatcagcatggagatttgtgatggatgccaatgtgccttcctaaaatgctgcaaggctattctggaaaaacagttctggagacagattctggcattaactatctctgttaacatagtggtagctaggttcttcccacttctgcttgtttcagctaagtaaaatataagggagtccagtaattcatgaatggataaacaaattgtgatacatccttgcaatggaatattatacagccataaaaaggaatagagtaggttaagccatagaaacacaagttagatgagtggcaggggtgggaaggagggcctacttataggtctgggtttccctttgaagtcatggaaatgttttggaactagacagaggtggtggttctacaacatcatgagtacactaaacatgactttaaaaatgtttcatatgtgagtttcacctcattttaaaaatcacagtgcacaaaaagaggtaagggaggccagagaaactggacaggaaaacccaggtgtgaggaccaggaggaagagggtggggcagaggggacaaggcagattcgaggggatgttccgccacattcttcagggtggcatgggcagcttttatgtagatgaaaacaattttaggaaattgcagcctaaagcggtgttcagtacacaagagaggccctcaagagaaggtcaccaagggaaggcagaagagcagcctctgcctgtctcagcaaagagctgagtgggcacccaccccatggtgatgctcacggtcacagcctagtgacccacacttgtgtctttgctgtcaagcagaagctagtgaccacgaaactaagcttaacttctggtgttctttacttgtgtaaaggatcgtaccttacatcgtagagaaggagtagaccaacactgtgtaatagacctctctgcaatgatagaagtgttccataactgcaccgtccaataaggaagccaaatagatagtagtccacgtggtgactattgagcatttgaactgcagctagtgcagctgtagaactgagttcttaattactgttttttaaatttaaatagctgcatttggctgatggccttactgttggaaagcataggttttgaatgtcacaggtgaaaactgtctttagcatcacgtgggcctatgttttaacaccaattttgcctctcccttgctatgtaatttgaggcaagttgtttaatcgtgaactttagttcctcatttgtagaaaggtagaaatgagagaatatgcttcctagagtcactgtcgagataaaatgaggtatagcatatgaagtacgtggaactgggcaaataataaatacttgataaacattatttgtgtctttgggtattgataacttatatatgtcttatgcagtggtgctttgagaaaatgaggtacagagaggtgaagtaactatgctcacgtcacatagccagaaggcagagggctaggaatttaatcccagatgttctgatgccaaagcccatttgcttgctactgcactgggtttcccttggaatcctggttaccaaattcatctcagcctgtagcattagactgggactgaggagtggatccctttttcctacaagttcgtccattaggtatgaactgttctggtctttgctgagatggtgtattagtccattttcatactgctatgaagaaatacctgagactgggtaattcatttaaaaaaaaaagagagatttagtggacttacagttccacatgtctggggaggcctcccaatcatggtggaaggaaggaacaaaggcacatcttacatggcggcaggcaagagagcgtgtgcaggggaactgccctttataaaaccatcagatcttctgagacttattcactatcacgagaacagcatgggaaagacccacccccatgattcaattacctcccaccaggtcactcccatgacatggggggattgtggagctacaattcaagatgagatttgggtcaggacacagccaaaccatatcagatgggatttcttgtaggacttgaaaccctggggaaacatgtggttgtgtgatggatttctatgtccatagtggtctttgtttcttacctaggttggttctgggtaggttctggactggattggcaggggagatcctggtctctttcatctcaggcacctaaagtcaaatctttcagaaataacatttaaccagtacctccatatgtgtttttttgtttgtttgtttgtttgtttgttttagcgttgaacacttcttgttgaatgccttctttttcattctatatgaaaatatctccaagtcatggagaactttgtctggcatggacaagggcaagacagtcttcttctgtcctgatgttagttggaaggacacatcctattctcctcacctttgggctaagagcagagtttgggtttttaatgaaaattttgtcctgacgagagataagtcaaagtcaggcattgcaaagtgccttgcatgtgctgttactggcatctcagttacattctccatgggcgcttaagaagctaacactcactgttggtcaggggactgatgctctacttcctactctaaatatagcgcctgtcttgtcacacttgctgtttaacagccttaccatgccattcttgagagaaataaagtgaggtttcattaatatgagagatcaacagtagttcagttataagttatcactgcagagggagagcagcaggttcagctcctcaagttggaaataaaaaagatgaatgggaggaggaaatgaagttagtgatctaccgcctgggcactttgtcaagggtgcgtgaggagagaggggaaagccctttctaaacacagattatacaccaaaggcaattaataattgtttaatccttctggagagccatttgttgtggtgatattcacatgactgtctttaacaccatgacaccaggagggtcttacttcgccagccaccaagctgggggcatcatgctgggtaattgtctgcaggtgcatttaactgaaacctttctctaagattctggagttcacagcacacaaagaaaataggcatagcatcattccagtctgtctactttctgtgactgaggtgatttttttctggagctaaatctgtcttttccacttgttctactctcattcactcactggctaattcaacagatacctacttggctcttactacctatcaatcactattcaaggcactcagtaacagcagtgaaccagagtttccaccctcagggaacttacagcagaagagcaggcaggtgatgagaaatgcccctgagtaaagttaaacaggaccaggaggatggggaatttgtggggggcaggggagctggaggaggtgcatgatattgtagtctatacatgatgatcagagatggcctttctgaaagggagacatttaaacagagatctgatgaaagagaaggtcatgagctatacaaatatctgtaaagagagaaagccccacaggtgtacagccagcaagatggtggaggatgcaggaggttgggtgcaggggaactgttgcaaatcgtagggccccagagtctgacaagctcaaggcaaatcctatggaaagatttttttcttttagctgctctgcctttgttggtgtacccctcatttcttttttcagcaggccgtgaccccttcttggcaaccctggaagtaggtgcaaagatccggaggtcaaagtgggcttagcatgtgtagggaacgtaggcctgggagggggtggatcactcagggccttggaaactttgcatggattctggcttctgagtgaaatgggaagcactgaaggttttggacagaggcaggatgtgttcagatatctctttcaccaggaatgctgtaaacagattggaggggaattcagtggaagtgaggagccaagctggaggttactgaaggaaaccaggtgagaaagaggagaacttggattagagagtgaggctagagtgcccatggccaaggtggaggtgataaaaagtggttggatttgcagtatgtcttgaaagaggcatcagaatttgctactggattaggtgcagtatgtgatgaaagagaggagggttgagggtagtgggaagattttttaaatatttcaacttttttaaatagtaaaaaaaaaaaaaaaaacatgactttaaatttactgtcttaatcttttttttttttttttttttttttttgagaaacaaggtttcactgtgttgtccaagctggcttctaactcctgtgctcaagtgatcctcctgtctcagtcccccaagaagctgggcctacaggtgtggacctctgtgcctagcttcttaaccatttataagtatgcagtaaagtagcattaagtccactcacattgttgtgtgacaaatctccaggacctcttcatcttgcaatagtaaaactttatacccattaaacactaattctcttcccccaaccctctgatcttagcaaccatcttctcactttctggttctgtgatcttgactgctttagatactttgaatgtgtggattcatacagtatttgtccttctatgactggcttatttcactttgcataatgcacttgaggttcatctatgtagtctcatatgacaggattttcttctttttcaagaatgcatcatagttcattgtgtggatataccacattttctttttccattatccattcatctatcagtggacatttgggttgcttccacctcttgactattgtaaattacacttcactgggtatgcaagtatctctttcagatccttcttcaaattctttcagatatgtagccaggagtgagattgctagatcatatggtaattgtctttagctttttgagaaacctccatgttgttttctataatgattgtgctattttatattctcaccaagtgtatacaagtgtgacaatttcttcatgtcttttcaatacttactctttctgtttacttgatagtggacattttaatggctttgtgcagtgacacctcattatggttttgatttgcatttcttttaggattagtgatgttcagcattttttcatatgctcattagccatttgtataacttccttggagaattatctattcaggccccttgcccattttttaatcagtttatttggatttttgttggatgaagttggggaagttctttatatttttctggattttaaccccttatccgatatatgtcttgcaaagattttctcctatttagtaagttgcgttttcattctgttgattgtttcctttgatgagcataagtttttaagtttgatgtagtttcatttgcctagttttgcttttgttgtctgtgctttttgtgtcatatataagaaatcattgtaaaatccaatgtcctgaagctttcccattatgttttccactagcagttgtatagttttaggtctcacatttaggtctttaatccattttgagctgatttttgtatacggcatgaggtaagggtctaagttcagttttgcttgtggatattcagttttccaaacaccatttggggctgctcatttcccattgtgtagtcctggcacctttgtcaaaaataattcagccatatacataagggtttatttctaggttctctattctgtttcattgagctagatatttgtcttcatgtcaatacatacaattttgattaccattgctttgtagtatgtttctaaaacaggaagtacgaggactccaggactaagagattttgctctcttgaaccaaaagatggacagattgccatttactgaggtggcaatgactgagagacacaggtactctgaagaatataaggaattttcttgtgccatatgaaagtgccgttagaaaaataggttggtcattttctgacatcaaaagattttttccccaaattgtctgagttgcagccaatataaacataggccaagtttttctaaatcagatgtgtttggagagggtggaatggctgtcagaatgggctgggcttatagggtgacatacaggtccaggcagagtgagccaaccaacatcacttgcaagattgaagaaggctcatggagttagatcagtggaagagaagatcctcatagaagaggcaaaattctctgtcttagggacaatggcaatacttgggaaaattcccagaaagtgatagttttagatgattgtcttcttggagaccgatgttggggaagactctgaggctgcttccagatgcagcaggatggagaatgactgtcagttggcaatgtccacctttggagacagacatatcagtcactttctcacttcccctgactcagctggattctcatcttctctggctcagaggggagtatcatcaagtacagctaacatctttgagcatataccatgtgtcaaaaactattcagcttttcttactctttataagaactcggtgaagtaggcactattattattttcatttgaatgttgaggaaactgcaggattgacaggttaagtagcttacctaagacatggtgagtaattggtacagccaggactggaaccctggccacttgactccagtgtccaggctattaaccaccataccgccaaagagtggcctcgtaccagggcctcgagctgcctggggcttcaggagcttctctcatctatggctgtactagtctgtttcacgctgctgataaaaacatacctgcgactgggtaatttataaagaaaatgaagtttaatgcacttacagttcctcatggctggagaggcctcacggcgatggtggaaggtgagaggcacatcttacatggcggcagggaagagagagaacttgtgcaggaaatttccctttataaaagcatcagatctcatgagacttattaactatcatgagaacagcacaggaaagacctacccccatgattcacttacctctctcacctggtctctcccacaacacatggtaattgtgggagctacatttcaagatgagatttgggtggggacacagccaaatcatatcaatggctaagactccatctctgtacagggggctgggagattcacttggcaatttttgttcctcttggcttcaaaggactcaatctaggatcatcacaaaatgtatttattgtccaaaactggagtgcttttgagagcaaaaaggactatgttaatatttaggctaggactacaaacataaaccagtcttgtccggagcaaactggaatatgaggtcattatacttatggtcagttagtaaatgagatcttagcctcagtgaaagtgaaattttactggaatgggcaacctattgaacacacactttatccagatggcttagatttggatcttttaaaagagtaacatcaccatttgaagtgttttcttcttcattaactatgaagccctttcccatatgggtttatcagcattgtaggaagggctttcatggaaccatataaattcatctctctagaaacgaagaattctaacgtccatcctcacttctgccaccaaaattagaaacatacataggtgtcgagctttctgcttggtgaaggtgcagtgacccctctttttttcagcatccatttatttctgctcgctgagctttctgtctgcattttcatctacagctctgttctttattgatagtgtttgttttagacttgtgagctccaagagggctgagactgcacactttaaatgggctttactgtgttggcacagcactttgcaaataaaggctttacaatttatttaacaaacatctagtgatggttactgtgtgtgaagcagtatacatagcacatggaagatactcaagggtatggcaaaaaggatttctatttcccataagtttatcagcagtaagaagtaacactgctaatgtctattatgtatagatgccatcttatctgtcagaaactgtgctcggtgtttaacatacattctctaagtctgtgccactgatcagtgtttctctaagtagttcccctggaacactagttcttgcaaactgttgatgaatgctatgtgtgtcattggtccccaacaccaccctcagatttggtgatttgctagaaagactcatggactctacatctagttgcatttgttgctaaggtttgttacagtgaaaagattccaagcaaaatcagcattaaaggcacataggcaatgaccaacagaaaccaggcaacagctttcaagcggagtcacacgggacacacttaattcccccagggagaaatagtgacaacgagtataaaatgctgtctaatgagggaagctcattagagacttactgcccagagtttttcctggaatctggtcacataggcaccctttgcctgataggttccaaatccctgacctccagaaggaaaaacggtgttcagcataagccatatctatttgtacggtttaggcacgttgagccactcttatcagagaatggtaggaaccttccccaaatcatcattcccaaataccagccaagagccaaccttgcaggctggcctttctagggatagcagtcccacacttgctatgttggctcttttctggatagtatgcaaaaaaaaaaaaagtttcatattcagataattttgaaaaccttaatcaaccaattttaagctgctttctttacctctggactctaaattcccagacttatctggctctctgccaccccccactgtacatcttagaagatttttgctttgtagggaacaaccacaagaagttctcgtggggaaatgacatcagtcctattcaatgtagcattaaatgctgagaaaatccatagcaggaaaggacagtttaaaaatttatgaattatcttttcctttacacttcagcattgacagataagtgttaaattgaaatactgtctcatactttgatcacagaagctaaggaaagcaagtgctgaagccgcactggcctcctttggaaagtaaaacccgagaactccatctaggcttcgagttaatagatgtggtggtctttacacacctgtagtgaaggggtcatctgttaagtaatcattagctttttcatttgaattgtaaattcaaattgtttctcaatgcagtagacttagattacataaggttagagcttaagctttgaaaagtaatttaaatttgttttcagcatgttaaagacttagtcaatttttttccttttattttagtttatttttatttttttcctgaggcagggtctcaccctgtctcccaggctggagtgcaatggtgtgatcatggctcactgcagccaagacctccctggctcaaatgattctcccacctcagtcttctgagtagcccggactacaggcacgcaccaccatacccagcttgtattttttgtagagactaggtctttccatacagcccaggctggtcttacacttttgaactcaagctatccacctgccttggcctcccaaagagctgggattgcaggtgtgaaccactgcgcctggcccaaattcctatttcttgtttgaccaggatgtcttttgtcccaaccagaattagttcttatttattgttacagtcaagatttagaatagggttttattaattatatatttggactagaatttctttattctgcaagtgcattagttttggaatcactgataaaaaccaaaagttgatttccactaacttttccaagagggagctttaaaaattcacctgtgggaaattttatgcaaaaacttgaacaagacatagtatttttctgttagcaaattataattttccccctgattcagggggggtctgtgattgttttcttccctggctgctccttccatttgcatttgcaaagatcacattcctaatcttcacctcatcagaagcctcattttgattttctgctttgctgacttctgtactccgagagattcactagctcttaatcctatcattggcctggcattcttcctcttctctatacttttccatggttcattcatctccattttattccttctagaatgtatttttttagaagcaattaccaattcttattggtttgagctatgaaatatttcttctttggttgcatcttcagtgtggttttcttctgactgtcattgtcattcacttgaacgggtgaaattaacctctgcctttgaggcccctatgtttactcttcgccggtgttgctgccagaagcttaaagctggatctaatcacttccttgctgaaaccattgatgcttctctgtcgacttcaagatgtgttcagttgggacattgccgtctgtttccttcttcagttctcctttcccttctactccagtccttacaagtgacatcttctgttcctgcatgctaaaatgcccgtgacttctctaatgcagctctctgccttggtgcctttgcgtatccatctctactgaggaactgggatgacttcagcatccggggtagatgcctggcatgaaccagaaaggatatcagattagatctgtaggtgatggtgagaatggatacaggactgtttcagtcaagtacctacctctaaacaggagggcactgtggattttaggattggagatcattggtacctgtgccatcctggggaggtgggaagaaccagttcacagatctagttttgagcaaaggaacatggggttttagcaggtcatttagtgtaagcccactagaaggaggcatgtggtgtggggtccaggacaggctgtgagtacatgttctgcaccagacataatttacatggaggcttggggagaataagcttccaggtgaggaactcagtggctgagttgcaaagagctggaaatgagagaagcaagcttaatgactttgtacgtgcttcagtttagtgcatatcccactcttgtgtcctaatccagttatttttatttctgctgaactctgtacatcctgaggatgaagcccatgctgtcaccactttttttttaattaacagtgtctgttaaacatgcatgtgattcagaattagatatcactccccaccctcatgaaatcctctttaaatacttgatttattatttattttccactagaatacttctggatttttcatgaagcctgagggaaaatgagaagttattatctacatcatttttcactgttttaatgttaatcattgatacaggaattggctttcaccatcttggagtccaccccacctataattaattataaatcctttcagtggacaaaccaataacacttctatattgaaccaggaaccagagagcctaaatgcatcccctggatatcatctagtgagtcagaggcacagaacaaaatgtgcttccaaaggacagatgattcttcaaagagagctactgttctttaaatgtcacccatgtgttagagccttttgttccgctctgtttctgcacgctccatttctgaagtccaggaagccccaggctgttgagtggaaagagtagaaaggcgagagtgagaaggcaagatgaatctggaggggaagattcatgttttctgatttctgagggtccctcctgatcagcggggtgctaatgagatcagagacaggggatgtgaacaccacgggaacctgctggctttcttccactcacagcgccagaatgttcccaccagctgggacaaagcacagggagagcatcaaggaggggatgaaaaaagagatcaggaaggaagagaatagtgtgcatgagctcacgcgtgggtgagaagaaggagaaacagaggcaggggggtacataaaaatcctaccctctagctatgtccttcaggagcgggtctatctgttgttgtttgctacttttcctatgctcttgggagcttatcagaaacttcccctagatcagcagccgcaaatcagcagcaggaagccctgtcacatgcaggtgtcattgtatcatcataaaaattacttcccagggttagtaacttaaaatgaaagtcaggctcaagggtcatcaggtagttagtagatcaagaagatttctacaatgtagtacatctcttttctcttggcttctgtgatactaagtttcctggttccgtttctgtctctcagaatacttttcccctaaaggtgtaaagttctctccttcatgtacttctctttcatgaacttctctccttctaatcttaactgagccttctccaagttccttccctatctcattatcttccatttctcattatgttccctcacaatcttaaccacacccgtagcttcacccatcactttctgcaggaaattgcctgtctaccacagaactctcccctggaatttagtgtaggcaattgtccacttgaatcatcctcaaatgtgatgtgatgtgatcttccccttggtgcatatccaaactgaactcaacacttaactcgtgccctgaattttggcaaggaagttatcaccagctttcactctttgagtgcataacctttcactctgtttcttatactcagggactgtagtgtgtgttgcagtctcttatctgactctcagaaataactttgagtagagcagtactactaaaacacaaattcaccaacttttctctgctggaccttcatgtcgttctccctgagtgagtcccttttgcaagttattaatatatgtcacacagagcctgtttctcatatttattgaccagactaaggagagaacatcgtaccctctaacccagtggttggcacgcttgagccagctcataccagctttcgtgagaccgttgttaatgtctctttctcactctgtcttcactgtagcttgatatcagccatggcaggattgtcttcaccatggcaatgggcaacaccaaggattgtcttacttcttcacagagctggtggttaagttacagcagataactgccccaccacacccattatgtcctgtgcagttatcgatgatattaactttctctgcttgaggcactctgataaaacttcactgatttatctcatttaatcccaatagctacttcatgagaaaggtgccatcattctatctgttttacaggtaaggcaaatgggcactcagagaggtaagatctgacaccgtgtgtctgagagcaggtccatgccatcgaagtagatttgtagcagaaacctggctgggggtatttttccccatattagggatatgtctgtctccaattcatgtccattctaagacaatgctactggtaactgtgatggatcagactttgcacgtttttctttcttggaacaaacaggatttggaagctttgacgttggtgttacagatcatttaccaaaaaaactgctcataagacaggcccagttttctgtttggatgatagcttctcatgatggtcctcatgtgttaattgaataatatttgaactttaaattctttctacaaatgtttgactaacaatctccccaaaatagccctattggtaaccaaccaagtagttgtttcattgcaataggagtgtaatgagagacaacagatcctaagttaatgagttatccaagacctttagttgcaaatcctttagccaaatgaccatacccatgggtgtcagagcaacagtaattgtgaattattgctatgtttaaaataaaacaattttggtctagattagattttgtttataaacctgaataaatattcagattgccactatcagaaaaaaaactcattgacccaatgagcattcaaaaaagtcatttttcctcctttttactttttcattcattaatttaatattcaaagaacacctgatttatgccagccaccgttccaagtgttgagattagagggatgaagaatataggcaagatcttagctttcacggttcacattctagttagggaagataggataaaaaataaataaaaccagaatttcggggcgtgatgagccctagggaaaggaagtgatagcagaagtatgcagtcagaggctctgctgaaacagagctgacaaggtgtttgagcagagaagcgagcgttcataaggaaccagccatgcagaggtatgcactgagacgcacccagtcgagggaacagtttggagactccagcaaccttggagtaatcaagaaatagagagttggtcgtggtggtagaagtgaaataagggagataggattgtttagtgaataaatccaagaggaaagcaggacccagatgatacagagtctcagaggttatgagttgggatttattctaagtgcacataggaagcactgtagaattccaggcaggatacagactttcccatctgtgcttaggagtctaagctgcactctttctttcttcaagtgatatgggagtgacttaaattctttgttgcaaaaccagtgacactgttatgcaaacatgaagtattgaactatatggaagtatttatctgtttaaacattgggggaagagacttttaaaatatggtttatatgctcggtggttcggtaaaggtttttctcctgctcctcatcccccagccaaccttctccaatatattcagccatggctgactttggaggataatgaaagccacaacccaggaacttcctgatggagatggaactgtttcacatcttgattgtatcctagttgggaagtcatttcatagatttgtaagatattgccattgggggaaaatgggtaaagggtatataggatctctgggcactatttcttacaactgtgtgtgaatcaacaatgatctcaaaatagaaagtgtaatgagagaaaaagctctatttaagtgttttattaggtaccagacatcatgttaagtattttacatgaattatcacgttatccttacaagaaaattgtgagttctagcattgccccattttaaagagaaggcacctgaggctcttagaaattaagggatttgcacagttacccagctggtaagtggtgaggccagaatcattccagatggtctgtctccaaagctgagattcccaacctcagccctatgggacacatgtctgttctgtcctcattctgatgggtccaatctggaggtgactgaatcctgaatgtcaggaggcagcagagggtggggccagttctagagaaggcacatcacctgtctctcctgcaggatggtctgtggccattggcgtaggccttcgttgacaagccaagcctctgacatctgaatagctacgctgagaaaggtagaccttgtctttccaccttgggaatcacagtctgatggcaggcaggggctttgtgccatcaggcaacccaaaatcagggtaccctgcaaagtcacctggcagaggtagcagggctgggtccacctagaggcagggaacattcttcttcacacaaagaggccttcccctcaccaagctgagctttttaaaagtttaatctatagcccctgagggagtgcctctttctaatccctacaaagacccttataggtcagcagtgtcctgtattgactgatccccgggatgcattggatttttaagctccgagattatcccagcttttacctcttttttaaataaatatatatatatagtatatatgtatatatgtatatatatattatacacacacacacacacacacacatatatatgtatatatatatatatctttaagttactgtgctaggcatgcctggaagtctccccacccctaatgcatttttattttaagatttgactggcattttttagattctcttgatgtgtttgctacatcttttttttctttttttttttcatttttatttatttatttttattatactttaagttttagggtacatgtgcatctttaggcaagaatttattaggatgttatggttaatataatcatggccataacttcctaatgaatgcaaatggggaaaataagattttattaaccaaagatggtgaccttaaaaccattatatcttccttgtgcttatggagaacattttaggagcacgcctattcttaaagtgaattccgttatctttcctcatgctaagaatggaagggggcttaggctgagccaagtgacatgttgcaagcagttgtatgatgtcaccaagtgctggccgttggtgtctcagccacagtgggaagctcagcacatggattaagggccaacctggggcgaaggtgattaccttcttagaagacacttggtggagatgtttttgagtgtcatgactagggaggagtgcgcctgacttctaatgtgtaggaatgctgctcagtatcctaccgttcacagcacagcctgccccccaccccaataaggaatttcctagccccaaaaatccataccatcaagaataagcgtacagagttaacatcatgggactcctgagtcagagcaacttgttttcaaatcctacctgtgtccttggatggttgaccttaattaactttctgaacctctgtgtcctctcttctaaagtgtgtctcatcattatacctattttatagggtactaagagaattgaggtattgcgtgccaaacccttagcacagcacctggcacagagtaagtactcaataaatagtggagattgtaactcttactaatctggtggtggtgtcctcctcaaagtaaaataacaaggcaaaggcttcaaatcaagctgcatttgaaaagttgcattttttggtatcaaagtcctccaagatggatttatttttctattttatgattccgtaaaaggcttcctataagacttgtttgttgggggtgggactccctctctggtgctgctagggcggggtacctgacattagtcgcacctgcagtggattcgacacattaaacctcagagcattgcgtgagtgtggctctagaaagccgcctcaactgcccaggtttcttagcgatcagtcatcttgatcaaagtaagaagcagccagtgtccaaggcaaaatctgtgtggtcgtgttgagagaaccaggcacattcgccacaagatacctgtgccttctgccattaagcaggtctgacaacgtgaaagctggctgagctgagggagttgatgagctgtcaacctcaggggctgctcagcccttcgggggtgctttgcaagcctggttgccctccaggtgtcattttgctaggggttgacagagcaggctactgcccttctgcaaatactcttaagatcatgtgagttaatacacaggacatgcttagacaggggctggcactgttctcagtgttctgttagcaattattaccattattttcacttagatttgtcattatgtacacacagctgcctgtggacatgtgcaggcacatccatgtaatatattaatataattaggaaagtgggggcattcagtactttctaggtatacacatgaacagacacacaaatatacataggacgtgcagatgtaatgggatttaatgttcccaaactcttgcagtcataaccgtctgcccagagtcaatcttagatagagagccagcaccgtgaggccaagagaatgtcttgctcctggatctggctggtgttcctgagagaaggacaagacgccgcagtgttcctttgacccaaagatggaagcaagacagataacactccgaagtgtggtagcaagccaagcaccctggagttaggggcttaaatccaggcatcaggtggttatgagtcctgtgaccctgtgcaaattagcctccccacctggggattgggaaccacagcgaagtcacggagctgctgtatggtgcataagaaagcgtatagctcactgcttagcatcatgatcgttccttaaaatgagattcagggctcatggtgccaaggtcctcttggaagcctcatgcacagagtgtcttcagacctaagattgaggaacctgtttgagaaagtttcaggtgttcttcctcaccaccatcaccatgagcaaaatggattattcactggccatatttctcctttttacctcagccaacaaggcacgcaggatcaaatgtgtggttctaccataatgactctatggacaggatcccctgtggctggcatgctgtcaccatctcctcctccttttcttttttctctgatccttgtttttatctgcttgtacttctgccttattgtgcttagttgtgcaagccaccgcaaatccagtatggattgatgtggggtataaataaatttttaaaaagttgaaccttgaatctgttcaataattctccaggattttgcttagctttactgtgctgcttccaatttcagactccctagctttgcctattggctgactgtaaccataaagataactgattcctgtaccaagcctaataagatcaattaaattccttgtaaaaatggtccctactaggggaaatgctagatgagatgctaaaactcatctgtctaaaaacaagagacaagctctttcttggattttttctttttctctttctttctttctttctttctttctttctttctttctttctttctttctttctttctttcttttttgcagctgatcagtgctcctcatgcattttgaagcttctttgcccaaggtgtctgtgacagatggctcgtgaagcagcaggaatgcacaaaacctctgctattatttttaataaaaaaatactgactctagaataaattgactattgaaaaggctgagaattcagtccttgaaactaattgtgccaagtatgggcacattataacttctccagcatggactatgtggccatgatggtaggcttggcaattaaaaagacaagtggagagatgccccaaactgccgggcctcctgctccatcctccaggtttgaactacggctggttgcaaggagtgtatttgtgcttgcattagaaaattaggaacgcctgcagaaaatggctttcccacagataaaagactattaagtctcttaaatgctggaaaatgtcttcatgagcatattcagtgatttggcacttactccacatgagaacgtccctaccatgatgtccagtaaagaatgggctacgtgtcccgcagacttgattacctccctgctccagcttggctctttctacaagggctgtgctggcccaaacatcaatgtctcatttaacttttgaaaatcgtcctcttggcatctagacctgttgttttcctggcctgctaggataaatacggaattctagggtgacttttattatgctcttttcaatattggtaataaagtggcactatgctgtggataggactgggttcacatcccaactctgccttttcctgattgagctgctgagtaactcttctgcctcctgatttgcaaaataaggatactggcttttaattcctaaggtggttctgaagatgacatgagacaatgtcagtaaaatacctagcactaagcttggcacatagttggcatagaaaaggaggagttggcagcttgattatggtcaaatctaagaagatttgatgcagacccaacttcctagggccactgaggattaaataggtatatataaattagctcaataaaagtgattatttttttcttgagacagggtctcattttgtcacccaggctgaagtacagtggcaccatctttgctcactgcagccttgacttcctgagctgaagtgagcctcccacattagccttccaagtagttgggactacaggcgtgtgccaccatgaccagctactgttgtactttttgtagagatgggattttgccatgttgcccaggctggtctgaagctcttgagctcaagtgatctgcccacctcagcctcccaaagtgctgggattacgagcatgtaccactacacttggcccataagtgattttttaaaaataagtaaatatttacaagaaattaattccctgagatcgtcaggacccaaccttgtcttcattttaagtattgtcagctcagagttctaatgaggctacaagagcattagagatagactttcaaaatattaaaagaaaaaatttcctaggcacctccaatgaaaaggatatgttccctgacctcaagaagtttccagtggccaggcacggtggctcacgcctgtaatcccagcactttgggaggctgaggcgggcgaatcacgaggtcaggagatggaggccatcctggctaacacggtgaaaccccgtctctactaaaatacaaaaaaaaaaaaaaaaaaaaattagccgggcatggtggcggctgcctgtagtcccagctacttgggaggctgaggcaggagaatggcatgaacccaggaggcggagcttgcagtgagccgagatcgcgccactgcactccagcctgggcgacggagcgagactccatctcaaaaaaaaaaaaaaaaaaaaaaaatagttcccaggcccctgttagacttcatgctccctggctttccctctctcctacaaatattagaatttgttgctcgcctgctatatgttggggcctgcatgctgtgtgttgtgaggagggcaggcaaagctcattgcccttgggatttgttacctggcaagaaagcaaacactgaaccagtaatgataagtaatgactgattttgaaggaaccatacaggcacctaggaatacagaaagggatttccttcctgagttgggggatggaggaaggtttctttgaagaagtagcatttgagcctgcttcctcgagggtgagtaggagaaaagacagtagggcttcatggacaaagagacagaatatacacaggcgaagaggagagaaagcgacggtgagcttgaaaggttcaaagaagccgagacagctgcaactcaagtagaattcatcgtattttttttcttttactaaaaatagaatgacagaataagaaatttatataaggagtattcaagcagaccccaaaggccaaagttcatggatgaggtttcctctttcctctccgctcagcttttaggtttctttctttgtcccacccatcttcgttccctgatggtaggtccatgatgtagaaagtttacaaaagaaaatgtctcagggaaaggttcctccatgaatctgttaggaagaaaaactccagtgaggctgcacaccagcagcactaatcattttattttatttgtggctgtgtagtagtattgtgtggcgtatatgtaccaccttttctttatcgtgtctaccattgatgggcatttaagttgaatccatgtctttgctattgtgaatagtgctgcaatgaacatacatgtgcatgtgtctttataatagaatgatttatattcctttgtgtatatacccagtgatgggattgctgggttgaacgctatttgtatttttaggtctttgaggaatcgccatactatcttccacaatggttaaactcatttacacttccaccaacaatgtataagcagtcctttttctctaatacctcaccagcatctgttattttttgactttttaatattagtcattctaactggtgtgagatggtatctcaatgtggtattggtttgcatttctctaatgacactgatcattttgaagaatttattcttgcatactcttggttaaatgcataaagtgataaattaaactgagtctttataagcaagtataaattagtggttatttgggggctatttctgatttacacaataacgtatactaatcacattcattaagatgagtgaagaaattgatttagctggaaagcatagctctacagaggcatagccaaagtctggctatataaaaacatttttaccaccaatattttcaggcaaatgtgccaataaaaggtatattctatgtgaaattgcagcaccctattggaaatggcctgctttaacagtcctggttcctgcttattaagatgcaccttcttaatgtatgcaataaaaattagactcaaagatatctagtgatgtttagccagcttcagtgactggtctagaaataaaaagatatgccagtaaaacccgagtgttgcaaatactgttactgatgatgatcaagaagagaggaaggcactctgtgaaagattgggtacacagtgttctgtctgatatgtggcttttttggcatcaaatgtgcactgcggaccattggcacttttcagaggtggccaacacataggtgccagggacaattaacagagacgtggtggcaaactcattaacgcaagaagagaatctgccattcagagacattaatttaacatgacaccaacaggggtgtttgtatgtgcgcgttgtggtgtcagacattctgctctaattgagttaattaaaagttaatggcacagagcacatcgtgacgctataaataacaggcacgtgaccagtccttatactctcatttgaataaacctttagctcaccatcacattccacttctgaaggattcattccacatcactgcctctccttccacctttgaagagggtgagtgctattccatttgatacataaacaaaaggaattggaaaagataaaaggaggcttgtgtgctatgtcataaatatcacccatcattgccagccttgtacttaaacttcttgctgggaagggggaaaatgtgtcctcctagccagggctgtggtaggatgtggggagagcagggaacctcctgctgctcatggtggatgggaggccggctgagggggacagtcactaagaagatgagttggaagtaagattgatataaaccttatggatgggaaagctgttttcctctctgagcttcagtttctcatctgtgaagtggagctaatgagaatctggtatccacgtcattgaatgcttctcagcatgaaatgggagaaatctctaaaacacttgacacaatgttgggcacacagcgagtcttccataaaggttagatggtgctgcttggaaagtctgtctcctgagcgtggggagaacagcccctcaggtatggctgtacccacctccctttctcagcatccttgtttgggtggccagtggagttctcgacgttcgtttttaagtgttggtttggttgattacattatgttacaaatgcatccaaaaaaggaaatgtgcgacatagtacttacatagattacaggcagagaaacacttgaaaatcattcacttaagacaaagtcaatagaagacttctcagtctcaaatttttttttattttattattatacagtaagttttagagtacatgtgcacaatgtgcaggttagttacataggtatacgtgattttgactgaggaaactcgcttcagtttgcttaaaactgaatgctgagccttctagccctgaggcaaagaggtatccatggcagcttacctacctttcatgtttccagcaccatgaaccacagcaccccttcaagtgaaagaagcaaacttctttgggggcctaaaatcatgggagaaattcagattgctcatcgtgcaaccaaatgaacatcattcttgagtgattctaacaattgaaagaggacaaaaatgcttcttacgtggctctctcggaagaatttctggtaatagtcaaagatgaggactttcaaactttttggcaggttctcacagtatataatagttttttttttttgtaaccatgtacccccaatacacacacacacacacacacacacacacacacacacacacacacacgctctctcaaaacaaagtttacaaataatacttagtctatgtggtgctttgtagtttctcttctactgtcgcttgttacttaaaatactggtcatgacctataaattgattttatgatctaaaaatgaattgtgaaacctggtttaaaaaatgctgatgcaagatgttaggtaagaacatatttctgcaaaaatacttaagtggagggacaggaatgagtggggctaggtgtccagtgttctggaaagaattaaattttttattagtatctatttctcatatttctccccagcacagtcagttctgcgtggcgcagccatcctaccaaggggagtctgtgggaaccaggacacttgattgctttttagctcagtcttcgagggagtgctggagcaactctgtgcatcggaatcacccgggatcccagcaggtctgggagggactgagattctgctcccaggtgatgctgatactgctgctccccaaagtgcgttaggccatacactgaacagcaaaggaagagaaaaatgcaaagttggaaccttgtgtttcctggcctccaccgacagccccatccagtaatgcctcctttctccttcaagggcatcttattgtctcattactcacatttagagactgattatgtcatttagtaagccttcgattgaatatttaaaagccacttggatgaagttaaaagtcagcaaagaatgtatttgaaaagcatgcatagctcatagctcctagaactgacagtgaaatggatgcaccaggtcttggggggcggccatgtatcgggggagctctgggctttggtagcaggaactggtggagatctttttatgtgaggccattggactgaagcagcatcccatgtcctttggcccttgcagtagaccctcacatttcagggaaaggatttaagaggccccttggctcacaggtccactcctcagccaaggagaacagggcatcttgactgacccaccaagactttgttatgacatagtgaccacggttcagtttccatgcaagggggcgtgcatgcggagtgggcagatacagccacagcacatgggttgctgaaaactaagtggctttgagaggaaggtaagtgcttttgctaaacaccaactctgtggaaagctcattaccgatacgttaacttcatcccctcgataagccagctgttctcaattggggatgactttacccttcaggggagaactggcagtgtctggatgaatttttggttgtcacagctgggttggggggttgggggtgctcctggcatctggtaggtaagaacatatttctgcaaaaatactgaagtggagggacaggaatgagtggggctaggtgtccagtgttctggaaagtatctattagtatctatttctcatatttctccccagcacagtcagggatgtggctcaacatcctgcaatgcccaggacagcccccatgacaaagaaattatccagtacaaatgtcactagtgccaaagctgagaagccctgcaaaaaacttgcatgatagtgacggttttctttattttcctcttttttttttttttgatgacagaaagttagataacagtcacaagatcagaaagcgaataagtggcagagcttgaacccagatctgtggggtaccaggacaccctgccttcttgctgtacctctcaatactggtctcttgtgcctgcctgccaaggaacagaggcagtgggaggagtcactcaaagagtcttatgagcctgataacaaatgtgtgagttccctccctttgctgatcagatttgttctgttccattccggagtcactgcaaactaccaggttttaattcaaccgtaacctgtgggaaggcttcacgtctgaggttacctggtgcagctgtcttcacgctggcacactgagaagttaccaaatgattaatagccgtggagtttcccaaaacatccaggtggaagacacacaactggcttattgtcttttaatattcagtcatataaattgaatataagagggtaacagcaggcacccctggagacctgggcatgaggtttagcttcatgcaatcccctgtaagtataatttccccagaccacatggggtaatgggcctccatgtctctgatttgcccatggggggaggacattaagtctgcacagctgtggtgtaatcagatgtgtagggagactctgagagccagaggaatctcttttccatgctgtctcacctgaaatgcttgtcaattaatgtagacttgtggtagacattttgtttgaaaagaagaaatttcattttctttcaaatattatatggtgcaggtgaagcacctggggtttttctaattataccgtgagccattgggaagtatgaacatattttacacattaaaagacctggattttgctggagaccctagagaatgttctcattggagtccccctcatttaccttggaaaggactgtctgaatttgaaaagaaatctgaagcaggaaaaacatataaagaaatatgaaaaaatggtataactttcaagggaaagggtttccttaaaaattcatgagatgggttataataaatgcactagaataacttgtaacaaaaataccaacagtgtttctttggcagatgtttctcaaatatttggggtggtttcaatggttttaaaagctttctcccaacgcttttatgttgcctatttggaccaccaattgagtaagaatttggctaattagtgtaaattcattaggctttagcataattatatttcaaaccaaccagctaaattgatatgatgttgtttgtcctgagaatgactaaatgactgataggaaatgggatatattctttgaaactcgatattcttagagcttggcaaaccgtctggtgttcaaatacattttgttatttgaatgaatacatattagctatggatataaacaaggagggagagatggatgggctgagtgtgattatgccagaaaaacaggagtcgagctcatcgcaagacctagcagtaatttttaggaatcaagtgatacaggtgttttcataagttctcagatgggaaacaattagtgaaagcaacaattccacctttttgtacaaaacatccttttgcttagttggttgtctgcttgctcctcaaacattcggaacatttccaggatcagtgaatatataacagcgatgttttgttttcagaaaatcaggctgatagtgttgtactgaactcaaatctgccttttaggaaatatccatttcctcctggttcttcctcttgagatatgcagagatctaccaaccacatcacagaatggaactcagatcattaaaggacagattccttgacttggttcataggaatggtcttgactcctccctagccaccgcccactgaatggtttgatataaaaaaaacaaaacaaaacaaaacttaaaatatgatcttcgtgatgtggtttggccaatgtagaggattaaaaccattaccactgcttcttctgcttatgaggcttttgactggcttcctcttttctgtcatccaggttctcaaaccccatgatgaacggtgcaggcagggagagtggcagagacagcaggctgctgccatggcctcaatcccagccacttaagttggcttcaccattttcctgcccatgtgtactacaggttgacggctagagacactgtgaacatcccactacttgccactgaggctgaattttttaaaaaaaataatgatagcagaaacacctcagacagtctttcatgcagagactcaatttaacacttcagaaaatttttgttcttatgtcaagatcctaaagttcctagatagattccaagatagaagtacccaacctattgtggctctacatccaatttccattttttattagcatgtgattttcttaacatactgccattatcataagttggacaccccattttcaaggcaactgaagtgaatcagagttatagatagcagacatagggtataaattgctgctgcccaaccctgaatacattttttttcatccagtatgatgctctcctgataaataccacctgttcaatgggaatttaagacaggttgtcattttagcagtcaaactttctgttggatcacactgagtttatggtcagcttgaactctcaaatctttgtttatgaatttttatcaatctctgacttttccaacttggtttggccaatcgctttttgaaatagaactttatatttaacttcatcaataacatatgtagaaatatatatacttatatgtggatatatacatcgtatatatgtatatatagtatttgtgtgtgtacatattatacacatgtatgtgtgtgtatatgtatatatgtatatgtgtgtgtatatatatgtatgtgtgtgtgtgtgtatacatatgtgtatatatatatatgccctttaagactaatgcaataacttttaaggttctttttgattgaagaaatatatgtaattaatatcaaatcatatctatggcttgcagcttacccctctgcctacccctaatttctaattcctagagacaacacccctctaaactcctttggctggttttttttttctggcatttgtgtatgcatttctcaatacataattatactatcatcatactattataattttcacttataaacatttatttctcctattaaaactaaagatatggctgtcaaactatgcacacatttattatccctttatattctaggtttatgttattgtggctataagaatctgctgtaaataattatatgaaatacgactctgatagaattttctttgtcacctatcattttgtttttccaggtgttaataattatttcttcatttgtttagtgttctatgtattttttattaaatcctatgccaaacattccaacagagctgtgagatacttgtcaatgtctttaaatgtctcaagtcgtctgtttgtttgttcttattttcttggaatttgtttttcttggaattctctgtatttctgctctagtttcttcctctaagcctgcttctcagccatcaccctgactggccatcaaactgggaactctgtttgcctttgtcctgtactgagtctcctctttcccaaatcctttctctttttccttcctggttaacctctggattatgtgtgtatttcgcatgcctgaaaatcctttttctacttttagacttgcaaatttggctggatatagaactctaagttgaatatatttttcaatagatgatgaacttggaagattcattatctaattttctttcagctcccttttacataactgtcttctcttaaaaatacttcgtacatttcttcaactttatcttatgaccactctgttgttgtattattgtttaatctttgccatcataatttcaattttaatggttttttttgttctctcaatgttcatttttatagtaatctttgttttgtgaatacagtatcccctcttagctcttcaagaatatcatttacaggtgtttgggttttaaagattcacctgttttctgttgcttctaaatttctgcttttttttttttttttttttttttttggtctgtgtcatgttagaagggttgttcacattctttgtgaatctttgctgccgttgtcctctgagtgaagcactaaaggctctttaggagttttgcatggacgtgcatgaaaactgatgagcctcaaaatgggtgatggggttgggactccaccatcagtatctgtagttattttcggttttttgtttatttctgttttttagatggattctcgctctgtcgcccaggctagagtgcagtggtgcaatcttggctcactgcaccctctgcctcccagcttcaagcgattctcctgcctcagcatccctagtacctgagattacaggcgcctgccaccacgtccggctaatttttgtgtttttagtagagacggggtttttaccacattggccaggctggtctcaaactcctgacctcaagtgatcaacccacctcagcctcccaaagttctgggattacatacagaagtcactctcacacacatactcatatttgccttaccatttgtgcaggaaatcaataccattactacccaagaccaaaggtttcactggatttaagcactgacatgaggccaagaccatagctccttccatggatatatggtccactttaatttttatgaattctaccctaagaagggggaaatgttaattgaaattgtagccattgttaacattgaatttatcacttaatggcagttacttattttaattataacatctgtgtccaagtcagtgtgttcattgttgtattcctcagaaagtcttatcaggaacccactcccactgtaactaacacagataaagtcttctgctggcatcatctcccctcttcacactccagggaatacctaaaaaatggaaaaggtagactgtgccctttactaactcttaaggcaaagaagtttaagtaaggacaaacattaagccaatatttccgatatggatgttaaggttcacagcacaacaaacatcacaacctgtggctgtcttttacctcattcatggaggcttatgaagtacacttttcttctggaatcctctcttttccccacctctcagggcttcttggtgaggtccacactcttcactcaccattcctggtctcaagtcgggatgtcttgtcctaactatcaatgacccacagttacctctacctctcagctgagccctcagcctattttctttttttctactcatgttctgattgcaaatgacaggagttatgactgttgttgccccagatctcatcatctacttaaacatcgtcatctgccagtattctcagccttgcttttttttctcagtgttaagaatttgttagggaggagctggtgaaatcctgaagtgcagcagagacatgcatgcctcattctttgctaaaacagaatgccttcagaagcaagtaccagaaaaccccaacccaactgttgtaaacaaagaggaaaatttatcatttcacaaaacacaaaggctgaaggtgcagggaagctccagggatggttaattccccacctccgcagcatcagggattgggttctctccctcttcctgctttatcattcagagcccggctggattatcctcaggctaattcactccatgtatgcagaatagctgtacagctaccagtgtcagaggcaggcacatcggcttataggagaaagagagagcagctctccctttctgtgtgtgcgatgatttaaatgccctctccaaaactcacgttgaaatttaattgccactgtgatgatattaagaggtaagacctctaaaaggtgattaggtcatgggggctccaccctcatgaatagatgaatgctgttatctcaggagagtgtttgttaccgcgggagtgggctcccggtaaaaggatgagttcggcccccttccccttgcaagctcactcatcatatgatgcctttcacaacattacgatggagcaaggaggcctcgcctgttgtggcccctcaatcttggacttcccaccctccaggaccatgagccaaataattttttttcattagaaatgacccagtcattttatttaacaagatattatgttgtcatagcataaaatggactaagacatcttttatcaccactttcccagaagttcccatgccccacacatgtgctctcatacctcattggccagaccaagtgaagtgtctctcagtcacaggtgagggaaatgagatgaccatgaatggcaaattaatcaagctttactcatttagagaagtttagaggaggataccttctttggccacatgactgtatgggaaatggtggacactgacacacacaggtgtatatagatacacctgcccctatgtgcaccactgacacatggatattaactcagtggtaggaccagagtaaacccctgatcatagtaattgacataattataagtgcagacattaactgtactgcagtttgtctttagaacagtggtgtatatatacctatactcatgttgtatacaaccttcacaatatgtaggagaggaacttccatggaagtatgaacagaagatcaactggacagttacgctgctggtgagctgtgtgtagcctgagggatctggcacatccttagttcttttcgcacaaatgctgctgccagttggctcaagcatttcagggcagttgccacagttgttactacagttaccacattttttccaaaccagcagtcagcatacacaattggataggtacttctttccaatctgtgaattatttgatgtcatatgagttacagaagttcatcccgggtcatgtttaaggatatataaattacatgttgtagacaaagtctacgtttctacgtttttttgacagcacaagtgacatgaagtgaaatgcacatttcaatgggtgtcgcatcctggtctcaatagttttagtgcagacattcttcctacacaaaaatgttgtgaaaatttgaattgatcataatgtgattgatgttgagaaataggatttatatagtccatgaactactattgggtataaccacttgaagctgggcacaggttcctaaggagtgagtgtctgaggacaccacagagaggccagagctgctctgctcacctacccagttcttaggttctacctggcattctttagctctctgttgttaaaggtaaactctgccacaagccaaagaccagagcagagagatgggaggcttgtcaaagaagcatgaaggtgcttttatttccttctgaccagacaacttgctcagccttagcttcagcaatcaactacatctgtaaagacgcttttactgttggtgttttaaacagaaaaacaatgacttcataatctagaactctctagaacctccttttctattacaaaagcagctgcttttctctcctagtttttggaaatgtgaggcttcttagaaattcaaatgttgtgtcataacctaacatagtttgcataattgcagagaactcaccagatgactgttgtatcttatgaggcccctccccagaactcctggagagacctaaagtggggggcagatcctatcaccacagctttgtattacaaaacttcattaaatatattatgcaatgcattactgctgtatgcatcataaatagacacaccatccttcatgtctcaaatattgattatctaaactatcccacatcatctatttggacctagggatatgaagatacaaagatgcagtctgttggcagaataaaattcttaaacagatcttagaatagtgtgagttgttcctggaaggtacagagtgccatgggaactcagagaacagattcccaccccagtaagaattctgggatcactccaccccaaaagaatgagggttatgttgtccttagtgggaggtggtagttgtggattaggtcctatcatttcacacactgaccatctctgcccagtaccctgaatgagtgctccatgacatcatcctctttgacctctggccaccttcccttctcctagccttgctcctcaccaggtaatcctagacatatggacagctcactatcaagaggaggattggtccactggagaaccgttaatcccttctgcactttggggatgatctcatctgatttgtctgtcctgcttcctcaaagcccctaaaatgcatttctatgctaagttaaacagaattgattgcggctagatttactgagtcttttgaaatggttctattattttgaatgtaagaaaataatgtactacacctcctgagaaatagatcttctgcaacattttcattaatctctttattaaatgtaactggtttctctttggaaattaattactgaagtagtattgagaattttaatttccacaatataccagcaagagatactgctgtttctttatacactgttacacagcagggcaataatctattgaaataagcccaaaaagggggcagcttgtaattaaaacagtataacacgagtgtttgatgactctcttagtgctaaaatggccctgtcatgctgtgtttgggtggaataaaatgtatatttaggaaacagctctatatggagaagtcgacagactcaggttttacagtctgggatgtggctgtgtttcactgcaataatatgcccacgaggaaatacggtttgtttttggcatctgagaattacaaccattgctgcacaataggaagcttcttcccttagtaagccacccccattgtgaaatttaaaatatttaaatgatgaagcagagagcatcaattatcaatgtcggtatccatggaaaagacatgagtatgcaaacacctgagtgcacgcacagctcacgtgtaggtgcaagtccacgaatggatgcggatcctgtatgtgtgcatgaaggccctcattgacacagattcagcactcaataactctccctcacgcttagaggaggcttcatatttttcaagacacgttcctatctgtcatcttctatcctcccagacgtgttttctcatgataagaattatttacacatcatttacatttacagatttgctttttttgttgttagtgtcaaagacatttttgcagatgctgtgttgctcttctcttttctccttcctcactctcttctttcctgccttccctccctccctcccttcctccctcctttccttcctccctcactcctttcctttctctttcccttcctccctccctcctttcttcctccctctctccttcccttcttttctccctctctcattcccttcctccccctcactctaagtgctaagtatacagccatgaacaccaccagctccctgcttttagggagcccaaagtcctgcccactcagcatataaaatcctataattgcctcttcttggaaagcagtttattggttttgaccactgatacatgtacctttgaggtctatgccctatccccagaagctcctcaaagaaaacagtacaactgaatcacatattgtatcctttctggatgaagtctgttaactaaaacttgctcatcttcttgtatttccagtaatgtgggtgagtcttacggataagtgatcagggcagatcccaggctggacttctccttatcctggcttaaggccaccagcaacattcttgtgttggatctagacaccagctctaccgcacattgaggcagagttcataaaaaaaaaaaaaaaaaaaaaaaaaaaaaattcatggttgctgttagagccccaatcctgcataatgggcttttatttaaaaaaaaacaaaacaaaacaacaacaacaaaaaaaaacgctgtacctagaagtaactgtccagaaaagaataatataatgcatacccaagatcataaatactggaaatcatacaaccgctggtttctcaattacagtaagaaaataattcacaatactcaaggggaaggtagcacttgtgagccagcattatttatagaaacctttcttttatctttctttgcaaagtcttttactagaattatttatttaggataattagagaaaaattctgtaatttcaagtaaatattaactacaaatcaattccagtaaaaatgctgctgtccaatcatctgtgtcactgcacttgggagaaaacaatttatgttcaagcctctttagctggattaatctcttcaaacctaagtgatccatatgaagatcttgtcaccggaaattacttttgatccaatacatctcacatatcataatggtaataaacatttgtcttgtgccttacagcttaaaaagtgtttttcatccattatctctcttaattttcatattgatttttagaaaattaatttgttcaaccagtgtttgggtgcttcttgtttgtttattccacaaaaatttatggagtacctctctcagtcctcaccactggggatgcaatggcaaataagatgaagtctccagccataaagaaactatattctagtgagggagatggatgataaaattaaaaattgtgcaagtgcatgatccagtgtcagggaatgataagacctgtgtagaattaagaggccaggggttagatctggacaagaaatgcttgttcttgctacataaagagttaaaggctgagcatccctgagtaatgtgagactgtgaaccaggaggacagcgttccaggcagagtgaatatttggatcatgcctcacatatcgtactgcagttagcacttactacttaataccacacgggtattttcccatgttgttcaaacttgaatttttaaagtctgaaaaatattccatttatggatgtccttatagatttatagatatccagcgttgcagtccggggctcatcaaattttttccactccttactgagcttcagacccaccaggctgcagagagacatctctagcaaatcataatcatttgcgttaataggtctgtgtggcccctgaagatttcataaggtggaaaaactactcccaattcatggggattgggctggacacacttcagtagctttccttgaaaactggaggaaaggcagagctgtggcagagtcaacgtgggaaatgtggtctgttgagtggtcctaggagtttcaagaacaactattctgtgcagatcagtcagccctgtggggattttagacgtggattgtactctgagagctaatgatgagtttgctggaaataatttttccatttccatttctaattgttaatatagtacagtgagctcggtaagcacaatctgctcagataacccaatctgcagtgtgactggtgcctgtggctggtgcctacacaacaggcttttgtttcgtaacttcagcacttgttgtggggggaagcaccacaaagctgctatccattgagcagtctttcaccctagttttggtgcatatcacttctttaatcaagcaaaatggctctaaaataatatcaatttttttttcttttttaaacttttaggtgcaggggatacatgtgcaggtttgttacgtgtataaattgcatgtcacagaggtttggtgtacagacgattttgtcatccacgtactaagcataatacccaataggtagtttttttcaatcctctcccacccccaacccttcaccctcaagtaggccctggggtcttttgttcccgtcttagtgtctatgagtgagtactcatagacatagtagtgtctattagctcccacttataagtgagaacaagggcatttgcttttttcttcctgcaagttcccataggtggcagctggataaagaaaatgtggtacatacacaccatggaatactatgaagccacaaaaaagaacgagatcatgtccttcatggcaacatggatggagctgtggaccattatcctaaacaatatgaattcttaagaagccaacagggaggcccatttaaaagcagccacaaaggggtacataaaagtgaagacaggttttaatgacataggtttcaagttaactactgtttgttgatctcttgtggtttccgtgggaggggcatttcaatactacataggtatcgtgtttttattttcgtaactacgcagcgaggtaagtttagttatctccacaagcaacatgtaagaaaattgaggctcagaggggtgaaaaggccacccttgatcaaacagttggtactgaacctggtttctagcctcacatgcaggacctcagagctcttaatgattcacccatactagtctatcataggcggcagtgcaggttttgcctctgaccacattgcttacactttccatcttcctctccaccacttacctggggttaagctctcttccagcctgcactatgacaacagcctcttcaagccaatcttacaccctctcgccttcccccaggccaggccgtctcctccatcccaacaccaaggtccctcaaaggaaagaccagtgaagtctcaaccctgcttaaaagcctcagtgacaaccattctgctgggtgggattgctggcaggaaggtggccttagggaaaggctggtttcagccaaggctggaggtggagagaatgttctagaaagcactggttgctggaagggtttgtggatcagagacctctcagttagctcaggcccttggtacatgctcttctctctgtttataatgttcttcctgccactcattatttggctcctaccctgagtgatcccttgcctccctcacctgctagagaccctctgccacaggcttcagttagttattccagcctcctgaaagcacttaccacagtttgaacttacctttgtgaggttatctgattagtgtctttagagctctctaagtaatgtattccttcaagaaagggattctgtctttccccccagagaaacccccacatgcagcacagagcctgatgtgtgaaacttgctgaatgagttgaaaataataagctaatgattttataaattcatttaaaggatcctcagcttctactgcaatggttctcaaacacctggtggcagggggggtgtttattaaatatgcacattcttgggccccacgccagatctactactaagaacctccatgggtgtgaactataatttgtaagcaaaatgtataagcaagctcccaggatgaattttgatttggataagagtttggggacttccttcttagcacacaaaatccagtctttattccatttaggtgtgttcaaatggtgtcatctcagtgagccctcctctgcccctcttatttaaaattccatacttccagccctgtctgacccggcactccctatagacacatgctttatttttatccagagaacttgtctgtcacttcccactattatacatgagggcagggatcgttggtcactcctactatattcccatttcctagaacagtgcctggtacacattagacatccaatacatgtttgaattaatgccaagtttgccccatagagcatttatgatgttcaaggccttaagcagctgggaaaggagagatgctgggccacataacttgagataatattgacattcttttttgctatttttcttttttccttttgattagatgacacttgagaaattaggtcagccatcatactttctgtccaaatggctgttgggtcatgtccacctaatagaaaggcaattttggctgctaatttcctgtctgatcagattaattgaattcagacagtgagcacagagccccctttcagagtaaagaagacagcactgacattagtgctcatgcaggcttcttagtttttctctgatgaggagctgtgttttatttccttgatcttggaattactgagagagatggagaagatgcaggggagctcagaaagcgtgtataggaggggcttaaggagggggcaccattttcctcctggcattagtaaaacctcaggagtgagccttatgactctggcttggaagataagggggggcctgctttgtcacttgtgactacaggattaatgacttggttatacgtcatttctgaacccatagtgtctgtcgcccactttatgggaattaaaccttccattcagagcaaataagttccccggatgccgggcacagtgggtagcggtgcagggaaggaaagaggggtgagggaagggtcacaaatgagccatgaaaactgccctgaagagcttacaaactaatgaagcactttcgtttttatgctttatgttctataatagaaaaaatcgaggtggcttataatgaagactacagattaatgatggtcatttaaacaattataacagaaggaaaaaatgtacaaggaaaggagttaattagaacctgaacacctaggccaagactgatttacaggatcatagcacatcaggattgaacaggcttatgaggagcactcagttcaaactcgccccacactctcaggctgttgtccgaatcctttcaagggacagcccaatccatcccaatcactccaactctgagaacttctgcttgatatatttcatttatcaagctgatatctgtttttccctttggtcctagccctatccattaggagccccccaagagcagccctatcattctacaagatggcccctcattgaataagttgagggtttcctcttgttctctgtcttctcttcacctgtgtctttggtgtttcccatatgacttgcaagcaccttgagccagtgattgcctctcaaacacctttgagttgcagaatgtatgagttcattttcaccctgctaattaaaatatacccaggactgggcaatttacaaaagaaagaggtttaatagtcttacagtttcccatggctggggaggcctcacagtcatggcagaagacaagagcatgtcacatcttgggccaggcgtggtggctcgcgcctgtaatcccagcactttgggaggccaagtcgggaggatcacgagttcgggagatcgagaccatcctggctaacacggtgaaaccctgtctctactaaaaatacaaaaaaattaccttggcatggtgacaggcacctgtagccacagctactcgggaggctgaggcagaagaatggcatgaacatgggaggtggagcctacaggagccaagatcaggccactgcactccagcctgggtgacagagtgagactccatctcaaaaaacaacaaacaaaagcatgtcacatcttacgtagatgttggcaggcagagagagtatgtgcaggggaactcccccttataaaaccattagatctcatgagacttacaatcatgagaacaacatgggaaagacctgcccccataatacaattaccccccaccaggtctctccaacaacatgtgggagttcaagatgaaatttgggtggcaacacagccaaatcatatcacagaactaccacaatacctgttacaaaatgggcactcaataaatactggataggtggattcattggtacctgtcttcttaaaagaagaaaggcaggataatcaatgagaggttttctcactcatggttatgaccttgcatttggatggaaagtcatctacaaatatgttttcaccttctcagggcaggctgaacaaagcctgtctgaaggttgtcagataactatgttctccaaagtatggggagtttattaaaaactcagatgcctaaaccatactccgaacctactgaataaggatctctttctgtggggcccagggaatctgcattttaacagattcctaggtacaattcagtttgggaatcctacaaaggctttaaaagggcaaagatttcttaaagtgtgatcagtgagaatccctgagactttttcaggggcttcatgaggtcaagactattttcataaaaatactgaggtgttttgtgcgttcatccctctcatatctcatgtatatatcatggagcttccagaggcttcctggtgtacatcattgaaccagactcaaagtagcagataagagaatccagcggattcccttaagtcaaacgtgaaagccctgcaatagccactctttctactatattttcttttgtttaggaaaatacagtttttaatttaaaaatatttttatgttaaaaagctatgagtttatttttttagtaatttggtaatctttttaggttttgtagaaatataaaggatcctgaaaccaaaaaatttgagaagtttgtttgctattgggcaacaaactaaataaatgtatttaaaaagtagatttcctatctttattcagtgaaatgctatatcaagtagttgatcccatgtcaacttaatttgttaaaattatgatttctattgataaaaggtctcatagttcctattctccaagaaggccaaggtgtttttgcagtattgcagcatgagcaggaatcaggcgctaagtattgctttcctttaaaaaaaaatgcattatatttcccagatttctggcaaatttgcagttattcaattttaagtagcgggaaccaaatccatctggatttttaaaaagtacaaccccaggaattttgtgatcatagatatgactcctttatctctcattcccaaagcttaaaccagatccagcttaaagtcatctgattttcttttagctcttccccattcaccatgggctccttaaaccaaagataccttctaagcaaaaggcaccttctaagctccaagacaaccctctgaaatggggaaaggtagcagtattgtggtaaaggtttaatgaatggcttggaggacgtgcaaagccaagccctgacttgccagtttccatggtgtgaagaatcccgttatagttggttttgagttgaagctatcaacccggcatcactaaacacggtaatgggaagggaaacatacaacaggctctggaggagacagcaagaaaaactgtctaaatccgttctctctttcaaccatccagagtttactctggatcctggcaatgccggttgaggtggcattattccagggtagtctttcatatgtcagcagagaagagaaggatacaagtgtggccaaatatgttagaggctggagcaaactccttgagagcatctgattcgcattctgtgaagaacctgtattcatagcaagaaatgaggctgaaaagagaagcagtgaatttagaacatgactaccttgcctggagaggggaaagggcaggatgttgaaccttagtctcataatcagtcttatcagaataacaatagccagcatgctaagcctggatagaaatacagaaagcacacagcactctgcctgccttatactgtagtagtgacatctttcctttttatttatttattttttattgtaatgggtgctcttttgggaagaatgaatcaactacttttgtgcaggttcgtctcattttaacttttttttttttcattttgtgaatttgaattgaatatttagtcacaggaaatagttttaagttctctgggaggccaaaggtaagaattccatgtcatagatacaaacgagtctaatatcagggctagatttattctgattaaatcattgtaagtcagctgtttttatagatctgaagtagaagagaaagtaaatatttcatccccgaggatttgttagtagagatttacatgcctccattccactcttgagtttgaatttaaaatagtcacaatgccgaggggctcctggatgcacgcacaaagtaattgttttacaattctgttagacaaaacccatagcacaatagctgcaatgcaagtgtcagaggttagggggaacattaaaatcattcaaacgctgcacatatctgccgcattctggaaaccgctgctaaaaatgggtattaaatctcaccttaaaggtcaggggcaatttacccatctttattaatgagtcgaaattatcctggaaggaaccggctattaaatatgtggagttgagacaatcggctatacatctgggaaaaacatcattagcttcctctctcacaacatgtagtgacacacatttctagatggatatgagatctaaaagtgagaagcaaaccataaaacatacctaaagataatataggcgtagctcagagatatcaaaggttgatttcagaccaccacaatcaaaggaatatcacaatgaagtgagtcacatgatttttttttttgcttttccagtacatatagaagctccatttatactatactgcaatgtagtaagtatgcaatagtttcatgtctgaaaaatgtacataccttaattaaaaatacgttataactaagaaagtgctaacaaacatctgaatctttttgctggtaaagagtcttgccgcaatgttgatggctgcagattgatcagggtggtggttgctgaaggatagtatgcagggtactgcagcagttttttaaaataagacaacaatgaagtttgtaacatcaaacaaggatttcttttccaaaatctttctctgtagcatgtgatgctatttgatagcattttacctactgcagaacttgttccaaaattggagtcagtcttctcaaaccctgctgctgctttgtcgactaaatttctgtaatattctaaactcttttttgtcatttcaactatgttcatagtagctttaccaggagtaggttccatcttgagaaatgtctttctttgcttatccataagagcaattcttcatccattcatgttttatgatgagatggcaggaattcattcacatcttcaagccacacttctaattctagctctcgtactgtttccatcacatctgcagttccttcttccactgaagtcttgagcccctcaaagtcatccatgagggttggaatcaacttcttccaaacccctgttaatgttgatattttggcctcttatcatgaaccaagaatgttcttaatggcatctagaacagtaaattctttcccgaaggttttcagtttactttgcccagatccatcaaagaaatcatatgccagctatggcctacaaaatgtatttcgtatctcataagctatagttttacaaaatgtcttttgaaagtcaaaattactccttgatccatgagttgaaaaatagatgttgtgttaccatacacaaaaacattactcttggacatttccgtcagagctcttgggtcactaggtatattgtcaatgagcagtaacattttgaaatgaacctttttttcctgagcagtaagtctgagcagtgggctcaaaatattcagtaaactatggtgttaacagatgtgctgtcatccagattttgttattccatttatagagcaagattaaatttcagaatggccaataagcatttgcttcaattttaccccctaaccagagagtctgcctattctttgaagttttgaagccaggcattgacttaatctctagctatgaaagtcctacacggcatcttctttcaattgaaggctgtctcatctacactgaaaatgtattgtttagtgtagccactttcatcaacgatcttagctggatcttctggatatcttgctgcagcttctatatcagcactcgctgcttcgcctagcactatgttatagggatggcttctttccttaaacctcatgaaccaacctccgttaggttcagacttttcttctgcagattattcacctctctcagcctttatagcactgaagagagagcactttggtctggattaggctttaccttaagtgaatgttgtgagtagtttgatcttttatccagaccactcaaactttctccacatcagcaataaggcagtttcacttccttgccattcatgtgtttactggggtagcaagttttgtttccttcaagaacttttcctttgcattcataattcagctgtttggtacaagaggtctggctttcagctatctcagctttcaacatgtcttcgtcattaagcttaatcagtctaggctgagtggtggctgacacctgtaatccccgcattttggtaggctgaggtgtgcagatcacttgaggtcaggagttcgagaccagcctggccaacatagtaaaacctcatctgtgcttaaaaaaaaaaaaaaacgtagccaagcgtggtggcgcgcacctgtaatcccagctactcgggaggctgaggcaggagaattgcttgaacccaagaagcaaaggttgcagtgagccgagattgcaccactgcattctaacctcggcaacagagcgggactccgtttctaaataaataaataaataaaattttagggaaagcttaatcagtgtagcttttgatttaaagtgagggccatgtgtctcttcttttcacttgaacacttagagaccattgtagtggtattcattggcttaatttaaatattgtgatatctcagggaatagggagtcccaaggagagggagagagatgggggaatggctgctcattgcagcagtcagagcatacaccacatttatcaattacatttgccatcttttgtcttctgcggacatggctcatggtaccccaaaacagatacaatagtaacatcaaagatcactgatctcagatcatcataagagacataataataatgaaaaatgttaaaatattgccagaattaccaaaatatgataccaaaacacaaagtgagaatatgttgatagacatgctcaacgcagggttgccacaaacattcgatttgtaaaaaacacaatagctgaaaagtagaataaaagcaaagcacaataaaatgacaatgacttatctgtgaataggagaagctaaaaatgtaacgttggaccagagagggctagtaagcaaggctccaacccaaaaaatagtaaataaaaatataagtcactaaaacccctgtctatttgggagatcataaggttataaaacaagtgacaacaggacagaaaaattttgcaacatacatgccagacagttactgtccttagtgtaaaaagagctcctgtaaatcaacaagaaagagacaaataggaaatggaagaaagttggcaaagaaataagttcttccagtgccttgagagaataagttttcctttccagcaaacctggacaccttaggggcttctgaacacattgcattgcttcctcattcagggctgctgatgggtggattttcatcaaagcatattttcatcctgttattctattgagcaattgacctctgtgggtctccatggttgataggctaacatgtaacctcatcatggtatttgatatttaattaaatgagataatttgtataatgctctagtacagttttaggccatggtaaactccgaattaattctgttcttcactccttatttatagcattgctgagaaaattaggtgagattctgtatttagaagaagaaaagttcccacttaatgatggggctgctcaataaatgttggtcctcttctctagaaaccctgactcattcagcacaatcccttagatcttcacagatttttaaatctttaattagggctcctccatcctggctgaatgtttgaattacctgtggagttactggatgataccaatggccaggccctaccccagacaagttgaatatgaactccgagtgtgggacccaatgtattttaaaaagttccacagaatggctgggtacggtggcttactcctgtaatcctagcaatttgggtggccgaggagggtggattgcttgaggctgggaattcaagaccagcctggccaacatggtgaaaccctgtctctactaaaattacaaaaattagctgggcgtggtggtgcacacctgtaatcccaactacttgggaggctgagacatgagaatcacttgaacccaggaggtggagtttgcagtgagccaagattgcgctactgcactccagcctgggcaacagggctagactccatctcagaaacaaaaatttccacaggagattgtaatgtgcagccaggggcaatatctacctgaaatgtcctttagtgttcttacagtggtgcctttatccctgaggtgccttttcccttccaccttgccatcatcggcctctctgtgtattaaggtcttagtttgagctggaaataaccttctttttggaacccctgcagcatttacatcctttggtcttagaatagccttttttggtaataatatctacttgtaataatatctttatatccagagttgtaagctcctggaggctggggatataattttattaatcattacatttttgtaatgtgtgtttcagcatttgacacatagcaagttctcaaaaactgttgaataaataaatgaatgtaagtgaatgaggatagacatgtatctttacacaagcctagagccaaaccattctctgtgagatctgaaaccaagcccctgtagtctgtgtgttatcaaacacagtagttagcttcacagacagccttattaactaactcatcccgcagttttcaaagagcatgtatttcttgtcattcatgaagttgttagttctggggaagtgttggactttggtaaacaccctctctttcggcttctcacttggattttcaatcctgagcaaagagaccactcaggagaagaatctgagtagtcaaagcagagagttggtactagatggcgctggacttactagctgtttgactttgagcaaattgcctgttagaccataaaatccttatctgaaaaatgagatacgatactaccacctgtttcacaggtaaaagtaaaatgagaccactcattaaaatatatttactctagtgccagctacttagtgaactctcaaaaaatgatggactccaggaaataaaaattagattaagattaaagagtacaggctactgtgaaaagaattgagcattttttagtggaaggagggaggaaactaacatttcctaactaccagccgtgtctgaggctgagaacttctctggtcaactcagtgcagaaaaaaatggcaaagtgtttaaatatattacataacataacatagcgtaatataataatatagtaaatataagtatagtgaatataattactttgattacataagtatgattagtaataaatgatagatataaaatagtgttaatataatacaaaatactatagtataatacaatataatgtgtatgtttctttttaaaaccttttcagtatacgttgaaggaaacaaagacccaagtttaatagggaaatgatttttgtaataaagtgaacaaactggataggttctcttgagctggttacagctgttttctgactgaattttaattataaaagatctagccagcttctatacacactctccctgcacaaatgttaactctggttcagacaccttttctgcacccagttattctcactcataatttctttctccttgggtttttgttttattttggaacggctttttaaccttcagaagtacattttgtctggaggaccagagtatcgatgtgatcctacctgtagattcttggcaagagagaaaatgttcttattaatgcagaaagtcctacccagaaggaagaaaacgtctcacctagaaaaaagtcattatgtagttttttctgggctcatggtttcctgaagagacctggtcctagtcaatttctccttggtattttattatttttgtccatttgaggtgaaatccggaggaagtaattatgaggttgttttaggggcacaggtggcattttcatggattggctgagctgactgcctgcagttgatttggggatggggtctactttagggtttcactgagtacaggtggtcacagatatccacaggttccaaccagtgatggaaaatattcagggaaaaaaaaacagtaaaaataacaccataaccataaaaaaagcaatgtaataactatttacatagcatttacattgtattagctatcatatataagtaatctagagatgatttcaagtatacagtggatgttggaagggtgttcataggttgcatgccgatactttgccgctttatataagagacttgagcattccaggattttggtgtttgtgggggagggatgttgaaaccaatatctgcgggtaccaagggacaattgtaactggattctagagcacattctgagtttgttggcagttttattaatcatatttgtattaaaatgcataacgaattatagaggaaaaaaaataaactctactcattgtggccaggcatcacagagaagtgggacaagggtgtggaccaaagaaacagaccaaggagcgtgggcgaactggagggttcctgcccatgtcctgcccactttctgttccaggtttcagaggagcaaagagccgttgcccaagaaataatggctcagccatctttaccctgtctcaaatgcaagtctctaaatttgttcctcctccttgtctggcaagtctgagcaacgttcctgcttcagctctctccccagtgtttgaggcatgaactggattccaggtgatgacttacccaaacacctcaaggagtttcgcctctaggacctgggtggaccttcactcttcccacatcagccccaggcagacctctctgcacgatgccagttgcatccatattacagctgacatttgcagttgactttactttgacaaatatttttccatttttatggtgaacccaaagagttctatcctcagggcatctgctagcccctgtggtatgtttgtgtagaatttaaaaggcatgctccctctggtcagaggcagctttacagatgtacaaatttgggtgatagaagtttccgttgtcaaatttaaaaatatatcctattcttcacacctgtaatcccagcactttgggaggccaaggcagacggattgcctgagctcaggagttcaagaccagccttggcaacacagtgaaaccctgtctctactaaaatataaaaaattagccaggcatggcagcatgcgctggtagtcccagctacttggggggctgaggcaggagaattacctgaacctgggaggtggaggttgcagtgaaccaagatggtactactgtattccagcctgggcaacaaagtgcgactctgtctcaaaaaaaaaaaaatgtatatatatatatttatatatatatacacacacacatataaatatatttacatctatctatctatctatctagatatatacctcatattcttgtgagtggactgaggctcatgccatgtggaaagtgaagcaagggctggatatttgattcctacttgtccccctgccatgcccgtgctcctatgtgtattataacctgtaccccatagatggttcttgagattactcctcctttcatctggaagataatgttcatcttttttagggccaccttcatgagcgcatgctgaaggtacccatgtaaaaaggccataaatgtttgaaaagccttcaggtactttataggccatgttcattctgcaaatgtcagtggaatgttcaggaagtccaacgtagagaaaggcccaggatggctagaatgaaatcagagatatccagtaggacctgatcactggcagaacccagactggggccagctgatgaagccagagaggcattcgcttcagggaccaaaactttcattcagtaagagcgggggtcctcaaccacgggccacaggccagtactagcctatgacctgttaggaacctggctgcccagcaggaggtaagtagcaggcaagcaagcaagccaagcttcatctgtatttacagccactccccatcgcttgcactactgcctgagctccacctcctgtcagatcaggggcagcattagattctcatacgagcatgaaccttattgcaaactgtgtgtgcaagggatctaggttgcatgctccttatgagaatctaatgcctgatggtctgtcactgtctcccatcacccccggatgggtccctctagttgcaggaaaccaagctcagggctctcactgattctacattatgatgacttatataattatttcatgatgtattataatgtaataataatagaaataaagtgcaccataaatttaatgtgcttgaatcatccccaagtcatcccctcacctcctcctggtccatgaaaaaattgtcttccatggaaccagtccctggcaccaaataggtttgggacctctgatcaagagtgatagcattgtaatgtaacatttttgaaactcaaaattaatgcatagaagtccatgagaagtaaaatgttaaagacaggatcaaaatcaatgcagaaaatccataatgagcaaaatatgaacatgttttaaaaagagggcatcagtattactgatttctttcgtttgactcaggctccagtacagcttatgttggcactgtgatgtatcctgtctgtatttaaaatttttaggtagtgtccatcatgacctttttgcagtaattgcgatttttaaaaatattgcgttaaaatagtacatatcttgattactgagttttttggtgcctcctttgagatggtgcagaaagcaagctcctcactcatctcctctagcccagccccaatagctaactcactcttagcgcctgtccttgagtgctgtgtgagccattgtgttgcaccagcttgttttaagtcccaacaatcttgttccatggtgtcttttaataatggaagagcaaagaggttaaatgactagcccaaggtctacatgaggtggaggaggagggaatcaaattaggcataaagcctattgcttggatcatgtttagtaacaaggagacggaaggtggaggatatgagaggctgatcaaggtcgcaggagcaagtgcagggcagagacagggtggcagctccctgtgccttctggaagccatcccccaagctgaaggagccacacagagccagctgtccaggcaggacctctctgcggtgacattcacatggcagagttaccaagaagaaagcttgtgtccccaagacttgtatttgaaagttaattgcttaaccttttcccaaagaatcgtcagcaaatattgcacacacccacaaaaattattttgcctttcataaagcacaagtggacatgtctttatttctctgcaaaacgagccgctgcagtgcaatcacttgaaatgtagggtctgaatgaaaattaatgctgttgatgaaaccagcagtctaaaacattacaggatattagactgaaaagacagtggtatttgcatccttttgaacattcgcctggatttgcataatggagatgtcacttatattgcaggagaaaaatcaagttacctgggctcccattaactgcctgctcgctacagttcccgtaaggggttggaacaccacctttttgaaatagaaaatgtgaaactcctacattcaccaagtgagtctttagtgaaacaggagtgaaaagaatcatgggctattgcttgctcctggcctacaagaaccaaaaaagacacatttctgctggaggcgaagaccaggaagaattcactgtctgcatatgaatgtgcgtgaacttggttgtcaggaaatgaacagtacataacccaacctgggacccttttggcctctacagcttgaaattgtaacaccagcttcactacccggttatattaatctcatgtatttttggtatctggtgacagcttctttctgaaaggcttctgtttagggcggtgtgtggtaactgtgggtgtacatcacaatcatcttggatgctttataaaaatgcagatgcccaggctccactttagtgtggaacccagatattgatattttttcagcactcttaaggtgattctaatgtgcagcctgcgttgagaagcactgctctaaaagatctctgctgcattttatccttctcttatttgaggctgttttaatggagtaaacatacaggattcagcataatataaatttaatattaataatgccagggacatctaagggcacattcaccccaacagtagaaactcagaatggggacagtctagctggaccatttatcagctgcttgggcttgggtacgtggtttagcttcttggtgtctcagttttctcactttgaaatggggataataatttcctttctgatcatatgtaaggatttatgacaatgtctatcatacagttagcctgtaaatgatacgttctattttatgtaaccattaaaacaatttctttgtgggctgtactttcatccagctggatggattttaaccaagtgatcccacctctatagccagcacccagattaagaagcagaacaagactcttcctcttatagccccttctaatcaccagcttctccccagagggaaccactcttctgacacttaactgtacagattagattggcctgtttggggactttctactgatggacccatgctgtgtatactcttttctgtcaccttctttcagtcatcatggttagtcagatgcatgttgttgttgcatatcgtttgttcattctcctccttgctgctgtgcaatataccattacgggaactaaccacattcaattctattttaattgttagtatttacaatggctccctaactgggatctcttttcaaacaattcactcttcagtccctgatatgatttggtgctgtatccccacccacatctcaccttgaattgtaataatcccctcgtgtcatgggaggcatccagtgggaggtaattgaatcacggggggcaggtttttcccatgctgttctcatggtagtgaagaagtctcacgagatctgatggttttataaggggagttcttctgcacacgccttcctgcctgtgaccatgtaagacgtgcctttgcccctcctttgccttccacggtgattgtgaggcctccccactcatgtgggactatgagttcattaaactcctttttctttataaattatgcagtctcaggtatgtctttattagcagtgtgagaacagagtaatatattccctcttatcgaatgacttctacacagtgtgaatgagatcagattcctcttcagtgcggaagaaaactagacctcttggtcctgtgttcagggcctttctcgggctccaaggccctcgttgtgactgtccactgtccatgcacgtgcactttttttctttctgaccatgcatcttcactcagggccgcctttcaccttgcttttcctgactgttctctctgcctactgcctagaatgtttttttcccatctctacgcagggaacatctatacatttctcaagatctggagttcagtttgtcacccgtgaggagcctccttccacttcgcctttgctaatccatcctgtcttttgtgcactcatgcagcatgtcacgcagacctttgttaaaggtcttatcaaatggtatttgacagtacaggtctatttctctatgagactacccgttgttcaaagcggcaagctaccaacctgatctcattcatctttgcatccttcatgctgattatagtgatcggctgttctcaattaatgaatggaagaattaatggataagtggataaatcacttaataaatcagaaatcttttagactttgctgctcttcctcgaagcataattctggttagaggtcacgtagtaaatatattcagggggttctacttcttcatcttccagggagaattgtcgcttttctcattcaacttttcagcttattgtacccccgctttgtaccccacctcactcccagcttctagatacctgaggtttggcgacccagctacgagactgtcccttccttccaccacctgatagtgcaaaattgggacaaagtcatcattaggcagcgtagttagtagcaagatattagaagtcctcagaatagcatttgcgttttcatatactactttgttaaccctatgcaaaaataatccaagatagaattttagtagatttatttccacagagaccaagatagttttcttggtggccgtcataactgtttgatgtaactaaaaataaaactagccctgactgctaataactcaaaaccggtggagattagagcaagggaaatgtggttaattcaactccagcttgctttgacctgaatttatgccaactgggacttttgcctgaattattcgggaaaatgccctgagctgccccttaattcatcttgtacgtttggtctcttacatattgaaaaagtgtgttctatgattcttttccatatagctaatgtcatcttgaccaggtcagagttcctccaagttgtttttaacatacaaatttatcacatcacgtttcatcatgcctgctcccaatggtcatgagttattgaatttgtataggagagttaatttgtaatgtccttgaggtatcatttttcactattggcctatgttggccacctttgtttacatttagttcagaaagcactaatttaagaagtgtcaggttgtaacaaaacataagatcaatgcagttagtttctgttcagactttaacaacttggtatctgtcaactgaagcatgaacatagatatgggcaaaacccaattaatacacagttgtaatcacagtgggacttagtggtactttctcctttgcacagtgggactcttagaagtggcttcattaatgttgcatttgtagtttgagttctgctcttcttctcatattgcctagttctgggcctccctgtcctctgtcctgtggccacttttccatgtggggacttttggggcctgatggctttttggtacctctgctgtcctgctagctgccaagaactctccattactccccctttgattgcttgggacacatttttaaataaagcagctttgggccacagcgacaaaaagtgtagagccatctttttgttttgcagcctctatttctgttttgaacaggtcttttcaaatcaagcggtaggagctatacctctcccagatgaggcccatcacacactctcactaagtaggcaatttctttggggtgataaaaatgattacaaatatttgaattggaatcgttgggaatctcattaaaaacaacaaccatgatcaggtgacattgtatttgtgaatatcctcagggtatgttcagaaaatcagtgttataagagcttgaacgattatattagtttagcttgatagtgctctgtttcttttctctttacacttgcatggcataatatattaataaaaattaagaaatttttagtgaaaccaatgaatttgctttcagaaaacagcattttacaatatctattgggtaattatatcaaatactcgattccatggtttctggtattggataaatgactaaatttgtaattaaacacatcttttggactaaagttactaaacagatagttgagtcaattacataacagcaatgggcattacattagattttatcacaacagtaattactgtgtgatgttagattctattttgaattgctctttctaaagatgggttatcagcaacagaatatgcattgggcttttatgagcggtctttgcactactcatatctgataagggccaaatcctatgataagaggtcagagactggtctggcagtaaagagccttcattaaattatttttaatagtaagcatttattgaagcttattacgttagaacctgaagagtcacagacatgtaaccttccccatgccttctggggtccttgctctaatttgggagatacaacacatagagaaaaaggtacatgaggcagccttgccaccggaagaaaatggcactcaaattcccagctgtcatctgggaaaggtcaattgttttctttacaaagccaccttcatagcaagactttatccatgtcagcagtctagaatgtcgtcatctttatagactcagaagcttgatttggtgtctatattcagaggttatttctatctcagggatagtattttactaatcaaatacataacagatatatacataaaccagaatgaaaacatattatagtgagaaatgtaattattgattgaactggatatttgtcttttcatgtcaacttattcattcagagcaggtgtgggaaaacaaattttagtcatgaaccgggttggaaagtattaaaaacgaggatttggtcatcttaacaaagtgtttctcagctacagtttcttcccaacagagtgggagctaacaataggaataacaatcagagccataatctctaagggcttcactgtttaccaggaattatactatgcccttagcatgtattatctcatttaactcccatgataacttttcatacaggtattattgttgcccctgtgagcaggaggagaagattgaaaaaaatcaataactaccccaagttgtgtagctaggacatagcatcaaggattccaagccaaggattatctgacttctgtttataaactatttttcttttagaattttttcctttcttttctaaaattgacataaaattgtagtttttactgtgtacgacatgatattttaaagtatctatacattgtggaatgattaaatctagctaatgaacatatgcattatgtcacagttactatttttgtgttaagaatattttacattcactcttttagcatttttaggaatacaatatattgttattcattgtagttgccatattggacaatagttctcttgagcttatttttcctatccaattgaaatgttctatcttttggccaacatctccctaacaactcccaattccctgcaaccaccccagcccctggcaaccaccattctactcactacttctgtgagctcaacattttagcattcacatgggaatgagactatgtggtatttgccttgctgtgcttgagttacttaacataatgtcctccaggttcatccatgttgtcactaatgataagatttcctgtctcatataatatatacatatatatgtgtatgtgtgtgtgtgtgtgtatatatatatgtgatattcatgtattgatggacatttaggaacaaattgaacaagggaagtgaatgatctttacactgaaaactataaaacactgataaaagaaattgaagaaaacaaaaataaatggaaagacatcccatgttcgtggattgccggaataatattgttaaaatgcccgtactacccaaaatgatccacagattcaacataatctatattaaaatatcaatgacattattcacagaactaggaaaaatcatcctaaaaatcatatgaaaccacaaaagaccatggatagccaaagtaatcttgagcaaagagaacaaagctgtaggtatcacactacctgacttcaaagtatactacaaagctgtaacaaccaaaacagcatggtactgttataacaacagacacatagaccaattgaacagaatagaaaacccagaaataaactcatgcatctatggccaactaatttccagcatagttatcaagaacacacaatgggggaaaaaaactcttcaataaatggcatttgggaaaccgcatatccatatgcagaagaatgaaattggactcctatctgacaccatatataaaaatcaactcaaaatgaaataaagatttaaatgtaagacttgaaactatgaaacaactggaagaaaacatagggaaaagttccatgacattggtctaggcaaggattttttggacataacctcaaaagcacaggcaacaaaagcaaaaataaaatgattatatcaactaaaaaacttctgcacagcaaatgaaacaacagggtaaaaagacaacctatggaattaaaagaaaatatttgcaaactgtacatctgataaaatagaaaaaacaatgaataattgaaaaatgggaaaaggaactgaatagacagttttctaaagaagacataaaaatggccagcaggcatatttttaaaatgctcaacatcactaataatagaaatgcaaattaaaaccacaatgagatatcacctcatacctgttaatatggctgttatcaaaaagataaaatataaatgttggcaaggatgtggagaaatgaggaacccttgcccactgttgatgggaatgtaagtacagctataatggaaaatagtatagagattcctcaaaaatttaaaagtagaactatcatatgattcaacaatctcactagggttatatatccaaagaaaataacatcaatatgtcaaagagacgtctgcacttctgtatgtattgcagcagtgttcacaatagccaagatatggaatcaacctaaaaattcatcagtggatcaatggatcaatggataaactatttttaattgaaagaattaaaattgtatctttatgagcctattgatgtttcagagaaataaactctggtcattgaatgaaatctctgtgttgcagaaacctctataagctcctatgtacagataatctcacagggtaaatttctctgactagctttccacattcttagcattcttttctcagagaacatgtgtatagtccttgtatagggccataattttcagatacacttttcccactcttctttgtgcttctctgtccttagttgcttttctcatttaatctttataatttccctgtgatttaaattatactttcattttacagatgagaaaattgagacacttatattcacatatcccactctaggtcagtcagtagcagagtcggatgatgcattctgttgttagtgcctggacaattaagtaccaagaaatgctattgattataggagttcatggtagggaagaataaggctgataagtaatgagtatagtttaagggcagacgtatttggaaaggggagaggcataagacaggagactaggaaatggtagacctctgtagtttattagtaatgtctgcctcggagtgacttggaggatgtggtaataaaagcatctgcatgtacccttgtggctataagtttcagttaattagtacaacacaagtacacacacacacacataagtggatctcagccatctagatgggacacagagtttttatgacaggcagggttaatgatttcataatggtgaacttttgccaatctcactactatttgaatatttcacaacttgttcaaattgttaagtacaacagcagattgcatgtacacccaataacacgggtttatgtaatgtacatgggtaaatgtacatcttccaagggagaaagggtgctctgtgtttccagcatgatggaacccagtttcatgatggattggcatattccatagatgaagaataattactggaaagaatgcagagccattggggactttctaaatagaggaatgatgagataagatatttgtttgggaaatcgctctgaagaagatggaatgaaggagagagggacttctggaaggctgtggatctattttcattttaataagcatggggggagaagggtaggagagaggatggtcaacaggtacaaagctacagtcacataggaggaataagctctggtgttctattgcataatagggtgactatagttttcattattatattgtgtatctgaaaatagctagaagggaggattttgaatgctctcaacacaaagaaatggcaagtgtttgagatgatggatatgctaattacctggatttgatcattatacaatgtatacatgtaccaaaagctcacattgtaccacataaattattaatacaataattgtacgtcaattattatgtgtcaattaaaaaaacaaaacttaaaaaatagtactaatgggaggtgaagaaggtgtgaataagggcagaaagactgagtgggacgcaagtgaatgtaacaaatgctgttctcaaatagctctaacttatctctcatgcaccagagcactcttgtttctcactgaacactttttgaatgcctctttcatgttgggcttgggcactgttctcagtggtctttgtagttagatgtttttgccaaaatgttggaaagagtccttgatatatggaaactgacaaagacataacttcaaccagtcaaggagatttcagtgtcagataaggctttgatgtgaacatgcctggcacatagatggttaatatatatcctatggatgaagaaacatacaaatgaccaaaggaatggaataggtagactaatcgaaggacattcaagatagacttctaaatgcccgaaacttttcaaagtgagatccagacctttcttgaggaatgatgtttctctactctgatctgtacagttggtgaaaataagaaagaagatggaacccagcacggcagctcacacttgtaatcacagcactttaggaggccgaggcaggaggattgcttgagcccaggagttctagaccagcctaggtaacatggcaaaaccttgtttctacaaaaaaaaaaaaaaaagaaaaagaaaaagaaaaaaagaaaaaaaaattagccaggtgcaggggtacgtgcctgtggttccagctactcaggaggctgaggcgggaggaaagcttgagcccaagaggtcgaggctgtagcgagcaatgatcgccccactgcactccaggctgggtgagagagcaaggccgtgtcaacacaagacgagacaaaatgagatgagacgagatgagaaaagaaaaagaaaagggaagaagtgagggagggaacatcagtgcaggtaaaatattatttttcttagaatgaaaccaagccagcaagaataataacttttgaaagcagtatttctccctgtgtagcccttagacaataggcatcaaaatttcttgagtgtatgtgacggattcctaggccctacctcaagcctgcaaaaataatctctcacagagagaaagggaactttaagcaagctcctcatttccttttgctgcagtaaaaatttctaagaatcagtgggttagagcttcctaagcacttaaaaactccaagaagtaaggacctgttattagaggtaacaagtataggctaatttgatttccttagaaaaccttcaaaacagcagtgtcacagaatcactcttgattaaccactggacttggaaaggcctaaggttgagaggctcagatggccccagagtaaaagccctcagtatgcctgcttcactgagcattacatgagactgttccagctctgtgatgatcaaataagaaaagcttgtgaggattttcactcttcacaatgtgatgtcttttccaataacagcattaatagagaagtgttatctttagggcatcttccttgctttatgtattttgcaataaatttatataatttttactgtttctgagtgtaaaagtaatgcatgcttgttttaaaaattataaaatactataaagcatgagtaaaaataaccaatattcctaccaccaaaagataagcaatgtcagtatatctcctttcagacatttttagtatgtacatatgcatataattttaccaaaatagaatcataccatatacactgttttgcaacctgttttatctaatctgaatggagataatatctttctgaatcatgtatattttcattttttaatggctggagaagataccacagtgtggatgtttctctttgttttattattcccttattttggatgcttgcttggattgtttatcaggccatgaaaaaaaaaaaaaaagatgaattccccagaacattataaggaaatctagggaaagacagcactaccttaccttaaactttctggctcatgtcacaaatcagtaggtttggactcctcatgcttgcagcacatacactcttgctatcctcattctctctaggaaccaccattcttcccccaagtctccatcactcatctgcttttccgtggcatgtcattcatcctcactagagatcatcttacttccctcgattattctttgttcattccacataagtgtattgagtacctcctctgtgtaggaattttaaaagaccctagctttatttagtgtttgttaaagcatctcttaacctcctctcattaaggatacagattcatgataaaaaccaaacaccttgaccaaaaggctaacttggaaaatgccagttgttattactgcaatctcaagtaatgaaaattcatggagtttatataagttattgcagcataacactttatcccaacacttagtggctgaaaacagtacataatgatgagctcacagcttagtgagatcaggcgtctcctcatggcttagctctgctggaggcctcaggctgtaatcacgatgctgaccagggctacaatcatcccaaattcagatgagggcaaggtctacctgcaagctcacttgattgttaacagaattgagttcctcataagttgtcaaatgagagcctcagtttcgtcacaggagtaatatcccatcacttttgccatattctgttcattagatgcaagtcactagttttagcccatactcaaagggaagagattacccaagagggtgagtaccaggaagctgggatcattaaagaccatctttgaagtcaaggatatgctcatagagctgatagacagtgataaaacctcagcaactgaccagaaaaggtcaacttagaaaatgagattttgtagtttaaactcctggaaattcatagatcataacatttcaacttacttttaagttgagtgacatgaagagataggtcaaaatatttacatttgctaaatgtgtacttactgttctttatatagagctttgcagcttacaacatacagttctgtgtcaatattttcatttgattttctcaaacctggaagggaggaatggaagatgttatctcaaatttaaagacaaatgaactgagacctgacaagttaccagctgagtaggttacatctttctgccagttcatgtgttggttcaacaaacgtatacaaacaaatcttatgtgcttggcaccatgccaggcagggtctggggacgcagtgttggacaacatgaatgtagttctgccctcccagaacctagtatcttgtcaagatgagacgttaatccaattaaatcttacataaaataagactgcaaactttaatattttctaatggttgaaaaggttatagatcatgatttatgcagtttatatatgcaggtttacatattttaaaattatccagctgcattcttaagatttgtacattttactgtgtatgtgatgtttttagaacatcctgggaaggaaagctacatagcgctaaggtagttcgttaaagaagacgtggctgagagccaggaaacagggatttagatttcctcttcaccaagtggcacatgtgtcctgaaaatgttaaactgtgggcatttttaatattgcacatgttgaactgatacatataactttctggggttttttttttttttttttttttttgagacagagcctcactctgtggtccagactggagtgcagtggcacgatctcagctcactgcaacctctgcctccggggttcgagccattctcctgcctcagcctcccaagtagctgggactacaggcgcccaccaccacgcccggctaattttttgtatttttagtagagatggggtttcactgtgttagccaagatggtctcgatctcctgacctcatgatccgcccgcctcagcctcccaaagtgcagggattacaggcgtgagccaccgcacctggtcagggttttatttcagaaccgtttatttccccagtacatttatccactctacctccctctctgtgattttccattttcaggctgtgccgtgctggttttacccagtaccttgtttaatgatggagctcatcatttcggagtttttctctccgtgatgctgccacatgtgtcagggctgtgtggctgttacagaggaagggtctcgtggggagggagcagtgaaactggtggagcaagcaaggtcggaccgacagactatcttctcggatgtaagagaggttgttctagggaagccgtgttcctggcgctgggaggctttacgaagagtttttgaaatctccagcttgaacgttagtgtaccttattatggctatacttggtctcaggatgccttctgccctcttattttttccttctttgatgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagacttcaataaagtaaatttaagaaaaaaaaaaaagagttaaggaatgaagtaaaacttgctagggttaaaatcccagctagtccattccttacctttcttacctgaaaaatgaaagtggggatcgtccttacctcatgttgttgtgagtactacgtgatgtaacacacagagaatgcttaacagagttctcagtgtagagtaagctaacaaagttgacagctgttggcctcatgacatcatagaaaatgtgcctaacctaaagtcagaatccctaattttaagccccgcttttacttcccggatattcatcctttattggttacttttaacctcctgttgcttcagttttctaaatctgtaaaagggaatgtaatactgacattatagataattccatggcaatcaaatcatggaaaatatgtagaagttcttggcacagaatagcagctctgtaaatattagtcgaatctgacttgtaacattaccaggacccaacatttatgtcaagaaggcatttttcacactgcacaaatggggctccttatattctagaaaataaatatcatgaaagtcacaacataaatgtcctctcacttcttatcccttaattcagagctattcaacaaagtcaattttgggaaaatgttgcaaacatctgatatttaccaggaattaggggagaaacagtggatactaccatggttcctgcttttaaggagctcatagtctaagagtggagtcagataagtcaacaagattacaaaataaatgccagaagaggaaaaagtgggagacgccaaggaggcaaggagggacaccaagcccagccacaataagagtgggaatgtcagagcaggtgacacagtgaggttgctttagcttcatgtgacagatatctctaactcagactgatctaaacttcagtgagaaaataaatttcatcaaactgggaggtcagaggaagggcagacttccaggtgcagtcactacagttgctcaaaaatctcatcaaggtattcggttcttttcatgtctctgatctatcatggctgctgtcatttccagtccaacagtagctctgtttcagtatcatgatggctccagcaattgcccacatgatggcatcagagagacaaggggcatctcttttatctgtcatctttgggaggagaaggaaggaaaagagaatttcctatgttcttttcagcatgggccagtgttggggccaagggaaagcttccccttcaccttccgaaggttcaccttctgccctctgaaaaagaactaatgttaggaagatgaataggagaaaaggcacacaaatttatttaatgtgtattagcctagaaaatcaaaggaggatgatcacgcaataacccagtaggtccagatgcttatacaactttcttcattggggaatgagagattgagtcaatgtgtctgtcaatttgaaggggagtaaataacttttagggggaatgaataagcccagtgctgagacaatggttagtaaataatgttctctttgggaattgaacaggattggagacaaagtttgtctgggctgtaggtgtgatgtttaatttccaggctctttgtcataataggagttttaatcttctggttaatgaagttacagggagggggttgaaggccatttgttccttttgctgggtatggtttgtaggtagataaggaaacttcaacgaacagccttatcctgtgctttgggagtgaaaggtgattgaaagatgaaggaatagggggaaggtcagagaaaccttgaggctactgcttcagtttagcatatctcaaagagccatattttggagtgttgtgttctgatccccaataccagaattaaatcatctacccacccttaaactacaccttggcaagggcacaggattctcatgacaggcttagtggggcatcttgggtgacaggtgcattgaggggttgacctccacaatgaccagggaaggttttcccaggggatctcagactttgcctatctgataggatgaattgggctttttctagtctctatgtgttagaggtagacagagaaacatcccagggtgtgcaatggtattgagcataaaatattttaattattcatggaattccaagtacttttatttgactagactatgggggtagcgcagagtccaaactagtaataggagataaggctggagaggtaggtgagggctggattatgaagactcttaccagccataagaaatgtgggttttatcccacagaaactgggaacacgctgaaatatttgaagctgagaagtacatgaaattggatgtgtcagttccatcttgaaccatccactaaatggaaaggggagtgaggcaagattggaatcttgggaaaaaagactgtgttggtaattttagaaggagtctgaatgggaccatatagctggttaagtgggtgggttggggaatgagaaggagctcaaggtgattattctgtttttttttctgggattttcaagcttccctagaagtctacataaaaatagatatgggaaaatcagaatctaagagctggctactcagatttgatgtagttaatacagaatgactatcaaataatagatatttgtcctcgatacatatgggatcttggccagctggataaataaatgagtattgttttaataaatgcccattggaacaggttctttactgaaaggaggaataatgataatattgtgttgtacgagagagtgtggatgagatatttataagcaaggcattcagcaggtgtcctgtgggttaatagtctgggagtaaattcatgttcatgtcatgtaataaccttggtgaagctgctagtaagagtgaattaggcttcagtagcaaactctctccctctctcccccacctttcctctctctgtctctctcccgtatgtgtgtgtgtagtgtgtagtttattaagtctttaagtattttattcatagcagaactttcccacttttcatattttacaaaggagcattttatttaagctccaagtatgtgtaattgcaatgagccatatacgcattccccacagaccgggaagctttgccacctaaaacagaatgctctcaatgtaagcccaggtgagagttctaaggggctgtcctggggggactctcctgctctgaagggggccatcctggtctaggggagctgtcctggtttgggagttggtggggctctccttgtctgagagctgactcatttgtaggcatcctcatttcagtgtcagaaggactgtcctgctgttgatgacttcactttacttaagcatggttcaatcagaagcaggggagtgaggaaattccttaacatatttatcaacatctgtttctaggcatccagctatgtacaggaaggaactgttgaccacagaaagcatcctgcttgggcatttctgtgcaatgtctctttgctggaaggaccatttttaatctacccgtgtagccagtatgtcctgaggtttccattctaatcccaaaatatgtatatgtcatggcacttttggagggttttgtctttctttgtacagcgttgcggtattatcataagaaaagtctagaagttgcaattatatcttccaagttggcatcccagttcttccacgtagcagctataaccttgatgcagtggaatacaggcgacatggcatgtgacttggagccagatgggagtttgtatcttagtgctgccaattaatagccatgtgatcccgggggcaaatgatgttccattttctttcatctgtacaatgggattaatactacttaccttaggatgttggtgaacagatattatactgtaaagctacctagtaggaggccaaacgcataatagatactcaataaattgtagctgtcgcaattattgacctcctggactctgtgtcctaatctacaacataggaataatgacagtgcctaacttgcaggtttggtgtgaacaatacagtgatcattctaatctagaacagggtttctcaatctcattcttggcactattttcatttgaggctgccctgtgcactacagaatattcagcagcatccctttactgcaccccctagatgggtgtagatacctgtagcattctgcagcccaggttgtaataaccaaaaatgtctcccgacattgccaaatattccctggctggggaaggtggggagctaacgttgtcactggttgagaactactgttccaacatatagaagaaagtattctataaacaagggtaggtaccgtatctgtgctatggtttggaggtggtttgttctggttcccaccaaggcttatgtagaaattggatccccagtgtgggggtgtcgggagcggggaggctagcaggaggtgtttggcttataggggcagatgtctcacaaatgctgttctggagtttgagtgagttcttgcttttgagagcccagattcattcttgtggggatggattaactcccctgaaaggaggctgttataaagcaggatgccccttgggtttcattcccttggcatgtgcccacttcccctttgactttctctaccttgttgtgacagctcaaaagtcctccctagaagtcagcgccgaatccttgaacttctcagcctgcaaacctgagctaaattataataattctgtaattattcatggaattccaagtacttttatttgactagactataggggtagcacagagtccaaactagtgataggagattaggctggaggggtaggtgagggctggattatgaggactcttgcaagccatgataagaaatgtgggttgtatcccacagaaactgggaacccaccaaaatatttgaagctgggaagcacatgaaattggaaattagactcttctttggaaattacccagtctcaggtatacttatagcaacacgaaatgggctaagacaatcagacctatccgtaaagttgtggaaagaaatgcagacaggaaaaagaaaatcatgtttgtttcctgagcctctagatagtaatgcatacatgagaatagtggaacaaattaaacctctttcggcatgaataagctcttcaaagttcagctccacatataagctacagttgggtggggctgtcaattttcaggaaaaacttgtggtaacaacacagggtttgcagtcacttctgctataagccatggtgtcctgggaatgtaagtggtaacgcctgttccctacccccgtggctgaggaacaccagccctgccctattcctctgtgggtgattgtggcgataattctagttccctggaaagcacacatctgagattcagcatgatgtatcttatccccagcacgattattttccccctcattttttcttaagcccttctcctgggaagataaaggtcaacttaaacctgagctccaggcagtgctacctcacttcctcttcactgatcaaatcttaaagcaacaggaatgttccagaattcctctaagtgaattgcacttgtctgtagttgtgtgggcagttctgaagtagctctcacctcacattttaaggcaattttactaataggagcaccaaatccttcagggccaggaaagctctatttaaccatgaatttcctcccttggggtttcgttatgtttggttacaaagtaaaataaacccacactgcttcagagtctggagaggcacaggggcatgatttagctatgttaataatagaaattgaaaagtattttaaaagataacacaccacctgtgccttcttttgattgtgagactaaatgaagaagaaattttttccccggaaatgttactgctctgaacagcattttagcactattatcccatgataacatcagagcgggggagtaattatttgccggtaatatgcgtgctgccgttagctgaatatggcagcacttccatgctgagatctatgaagtatagattatacatttccatgctcattcaaaatatgtattttttatgattgatgaggacattgcagcatgccaccttcataatttgcatttttaaatggttctgtgtgtaaatcattggcgtgtattacctcaatcagaagccaaataactaattgtaaaagctctaaaatatgcttttcttaaatatgttgtgcgggaatcagagataaatataccttaacacatttttatatttcattactattcaatatattttttttgttgttctaacaaagaaaacctccagcttttataataccattaccgtcaaattaaagactagccttcatctttccaaacatatattttgtgctttgctcaaagccaggaatgacctggctcatgaaggggttcattagcaagatgcttgaaggaaaggaaaaatttgctagttgatcgagaaaatataaatgatgaggctaaactcatatttgagatgttctagattttcctggtgagatttcaaggtccaacacaggattctaatattctcagaagatctcctacatgaattccttcaaacttgagaattacatttactctccacacaaagggagtaggaatttttcagtataaggcaaatggcaacaaaaacacactagagattacaaagccaacgtcactattatttttaaaaggctttatgaaaacattagtgctgagcctgggtgatttatggcacagatccatggaaagaacctttcctaagcccacatttcagctagggctttgcctgggagaaaaaaggaagcccttgcttctggaaggctcccctcaccgccgtctccatatgtgggaagttcagagctgaggtaaaatgaggaaggagaatcaagaccctggaaacatatgcccaagagggagcctgagaatctttgcagaagttgaagttgaaacagaagtttactaagatgctgaaacttaaagaatgaaaaccatcaactagaagagagtaggggattcgggaagcctccaaagaattcacaagaacattcagatgaagggaaagagggcaccaggtcacactgggttggttgccgagggaaatccctccccttgtgtcctaaatcattcccttgtcaccttgttatgcctcagtcctcagaaccactccttactgtggcttggtgcttgtccctccatatcgtaactctgttttatattcttttgactttcctgtttcttctgcatgtacatgagcctcattagcattgagcttgtgtctgttttgtttgcagcgttataccgagtgcttgcctaccagtgggctccaaagggatttttgcaatgactaaggtggaaattgaatttgggagtactgggatctttgggaaaagatctatatcgaagtcagatttatatggtgagagcactgtcttcagcagatgtcctttgagggtccaggtcagtctctggaggcactcccctctctcccttcttttttttttgagacagaatcttactctgtcacccaggctggagtgcagtggcatgatctcggctcactgcaaccttctgcctcccagcttccagcaattctcctgcctcagcctcctgaggaggtgggattacaggcgagtgccgccacgcccagctcatttttgtatttttagtgaagatggggtttcaccatgttggtcaggctgatctcgaactcctgacctcgtgatccacccaccttggcctccccaagtgctgggattacaggcgtgagccgccacgcccagccccctccttctgaaacttggaatgtcctgttgcaatccttagagcacctgtactcagggtatggaagcactcatgaggacatgagcctcagccttctggaaaagaggacttttcgcttgctataactcccatgggattttttttttttttaactttgtctttgtggacttcagaagtccttccagacaaatggctgctttatttgtgaggtagtgatttatatccctggcagaataatcctgggtgaaagtggctctccctcagcataaaggaatagcaaaacatttatgaaagggagacagagcttcagatgagtgggtacaaaagttccgcacaatatcaatggttgaaagaatatgcatatattaattaataattccgacatacttcttttataaggtcccttatgaaagatagactattttccacatttactgtgcattggaagtgacagatgaaattaatatgcttcataaattgccatcacagagggtcaattaacaagtgaactaaccttgtgaaagtcattttgaaagactagttatgtctgtaatattccctgtcaaattaggtaaaagtgggaaaattagatgcctgtcaaataaatagcagtctaagatacggagtaattgcatttttgataaggtaaattagtttctgtgattgttgcttgagaacagaaaatgagtagtggaaatagtaaagatctgaaaattctgtgtgtgggtacatgtgtgcacatacatacaaatatatgtaacagatgcatatttgtgtggatgtacacacatacgtacagagaggcagagaggagaacactgaagattcaaattggaagtaagacaggtccacactccttagctaaaccatcacctcctcttccaccaaggctattgccttttaggtccttcacacgtacctggccagctcccacctttctgcctttgctcacttggcttcctttttagttatgtctgcctctacttcattccatcaaaatgaaccctggtgcttgtacaatgggttggacagtgtttgggccatgcatggaccagcacaatagtgtctgctgccctagagctaaaattccctccaggagagaacaataacctaggaccctgaagctgagattcttgcaggtgacttgcttctgcctgcaaaaggactagagaaaggaaccctcctaacaaacccaactgagccagtttggaggctgaaggaattaatgtagcagtcagatcacatggctgttttcacccaatccacctgacaggaagttccagaaagaccacacaacacacacaaagtactcccacataaaggttatcctcttccaggacagatgtggtgggagcctccccacttccttcctgatgtaaaagttccatatggagttttactgctctcctgctcctctgacgtctcggttctgttcttcaaaactctgccatgtctgtgatgaaattaaatccctgactgggtctcaagttcctacttgtcatatgaatcagtagagcttaaaattcatctgaagtcttggttgtctgtccccattcctccatgacctcctttggggcttggagcaagtcaacttcttatcaggatgtgtgtcccggtgtgtgaaaggaggctgctttgcagcaaggagattgttaaaaaaaaaaaattaaaaagtaaaagtcgttatatttttgtgtataccagagcccagctacacatatgtaatgtagagaaaatactttctctccaatcctttttcttcctctgagttttctccttataccttttaattgtcagcgaattcccaaaggcatatgtactgaatctgcatgtggattttgtatatacatatatattcacaaatgcatatgctatgatttgtgattcccattttacagagtttaaaactgagtctcagtgaggggaagtaaactgcatgcagttcatgcagttactaacaacgtgccttgttgttctgtacatagcataggaggttgaacccaattagtctgactcaaggcttgtactctctatgatatccagaacgctcttttcttcaaagccaattttattccagcttggacaaattctacgcatcttcctaataaaagaagaaccttgccaggtgcagtggctcacgcctgtaatcccagcactttgggaggccaaggcgggtggatcacctgaggttaggatttcgagaccaacctgaccaaaatggagaaaccccgtctctactgaaaatacaaaattagccaggcgtggtggtgcatgcctgtaatcccagctctcgggaggctgcggcaggagaatcacttgaacccgggaggcggaagttgcagtgagctgagattgtgcattgcactccagcctgggcaataaaactccatctcaaaaaaaaaaaaaaaaaaaagaatcttgggagacagtgtgcctccacttttttgtctattggttgtattacaagttctttttcattttctgcccttgattgcacaatctccttctctccctggtctgcccagtgcagacagatacagatgagccggctcagtctgtgtccatacagatgcggaccagctcacagtactgctcttatgtgagctgctcagagttctgtgattgaaggacagggaaaaactgccaactaaagcaatagaatcattggatggacactggccatattttgcaaatctaaaagctgacagctgggtctcagaaaggacaggagcaagttcagttctggggatcccagcgagcatactgtctcttaggcagaaccaatggaataagtcctctccaaccaccttcaattcatgtgccctttgtttcttggttcctgttgccaggagagagcttctgattggcttaggttgtatcataaggccacccttcttgggcaggtttggaggaaacaacactgtgactgacacccctgccaggtctacagggaaacacagagaggtaatggccaaagataagcagaatgctgctgatgttagaagagggacaggaaagctagcaagtcacaatctataggcatctcccacaccatgtaattacataaaataaaaccacaaaagctcaatcacttgtctcttgcctccaaacctaaattgcaaatctccatgcaaaagtcagcaaaaataaaggcagcagcttgtgagtgtggggaaggccaggagaatttgacctcagaaaatctgcacttaaatcccagtcctggcaccatagctgtgttgccttggtattagatacaccattccaaagcccgctgtaaagcataagttttcccagtgcttgcagggagtcactagaaggatcacatgagatgcagcttctacaagtgcatggggaatcagcacccactcagctgaatctgctgtagaaaggattggcatcagggttgcagatagcaagtgaagctcatgcacatgctcatgagtttgcaaactgttttaaacacttgtaaaaatctctcctgagccatttatttaagtagagctgggaacattgaataaatgacagccctttcttaagggggagtctttgaattctgagtgactggcagatttcacagccattgatattttgaaaggtgcattggtgacttgaaatccttgagagcagttatctttgaaattgtggattctgcaaatgtagatattgatatccaactcaatatatgcagctttctctatataccattcagcatatgttagccatctgtcataagcatcatgcccctaaactttcagctatccagaaatctaacaactgccttttcagtaaggttactctgtgctaataattgaataaagcaatataagattcagccaaatagagtgtgtctgccatttttagaggttctcaacccaaagttgaagggccccaggccatggtagatttttaaaagaaattttgacatgggcagtgccaataaatgactctcaagaacccttaccattgtaaaaaaaaaaaaaaaaaaaaaaagggaggtccttggtattaccaatttaaaatgtgagcattctagagggacaaaacctataatgaattacaattgccttttttcccattattttagttaatgttgttaaacaatagtgtctggaattggctaaggaagaacagttacttgaaatatgtgctgttttgaataaactgatcctgtcttaatgagcttttatagggttttatgcatgacttactacccatattacattgctaaggtaacctacttaaaactgtggtgcaatatgatgtttttcagttcatttgtctgtttcattaatgatggaatgtattttccagcacacaaatcctatttatgatcaagacattgttgttctgtatatcaacttaaactcttacactgtgtaatttacctgctgtcaaatctcatttgaagagctgttgtctagcattgctctaatcaaaaatatgccccactgtaatgagctatgcatgttgtgtctagtattatttatttttaataaactttattcactcccaacacactttgggaaacggacaatctataatatcttctctcttcttcttcttttttaaccaactatctttccagctagggtgatgattcacaaaaatgtgatttttttttctttcaaatgtgtcttaatgggtaacagctgattagataaatgtacaggagaaatataaaaataatttggtatttaaaacaagactaatcattaataagacaagcagttttctaaactaaaatggctagaataatatgtgaaattagacttccaggacagagcaccctctgtgatttgaggagcccagctcattcattaaatatgatcaatatgcctcatcatggaaagactattccctgagatggcatgtcagtgtgttaaaaaaaaatacggtatttttttcatctacactctgtaaagacaagcccacaacttcatatggggctcagctgaaggtcagccatctcttccaacacaagaaaagaaaatggcggtgttggacttaatgagacatgattctgtactatacttaataggcgattttactgatttcatgggtacatcatgctgtagttttctctttacatgttgactttacattccaaattccacattaggtgcaacttcattctaagagctttgggatgcttgtatgtgaaacaggttttatgcacagctcttttccaacctattcttctttagtcagtggttcctgtgggttcttgggcctttgccttcctgtcttcagcctcttctctgagcagtgtgatatagccttgaaaagacttgggaggtgggcagaacggagtttgaatcctggctccaccctgtgtgactttggacaaggcacttatattcaactacaaaagggtcacccatgctgacgttacaaagtgatagtgaggaataacagagttacagaatgcagaagaacaaccagcacaatagtagcctgtctgtgtatgatgcttataattgtgatcatcatttatcctaagctcatatgtggaagcccacataagtatggcgtcttaccagtaaactccgctgaatccgaggaagggccttaggccttctggcaaggtaacattcagagtgctgagaatgctgctgcaagtggaatttacttatcagaaggtcagttaattccactaaactctgatgtcatatctagcttgtacaggaggcaaacaaacaaatgctaaacagtagtgcagaaccttggagttaactgtgtgcacatttaaacctcacctccaaccccactgtgtgtacagtaattatttccagtgaaatcactgctttctttccgtgaatgactaactggtgatgatattgtctggtatgatagtaactgcataagacctataggcacatagttcatcaccaatttgtgctttgtgcaatatttgcttcgggggaaaaataaaagaatcaccaaatatgttacaaactctggatttaaaaaaaaaaaacagctctaagaaaatttttaatttttttagtgtgttctcgctatcttggagttatttctagtcatcgggatcttgcatgatttaaacaaggcccttaggtgaccatcaatttatatctaaattattagtgtgcttgttatagtgggtgaatgttctttcagttcatttgctcattcaccaccaggattctacaccaggaactatgctaggttctagtgttatagggaggttaatatatgggagtatatattgaaacacattgtattagttgattttcacactgctctgagaaatatccaaataacccaaattactgggtaatttataaaggaaagaggtttaattgactcacagttctgcagggcttaggaggcctcaggaagcttacaatcatggtggaaggggaaggaaacacgtccttcacatggtggcaggagagagaagtgcagagagaaaaggggaagagcccctgataaagccatcagatctcatgagaactcactgactatcacaagaagagcatgggggaaccacccccatgatctgatcacctcccacgaggtccctccccaaacacgtggggattacaattcggatttcaattcaaggtgagatttaggtgtgtgacacagaggcagaccatatcacacatacacacacatactgaataattgctaccgtaattgatacactggcctagtggagggggaatctagtttgaactatttcatatgtgtcacgagcctggatttccagcatcataaactgggagaaacggggagcgatgcaaaagacagtcagtgctaccgctagagctggagatcagcatggtgggggatgctggctcctaaagcagaagtggggcaaatgtagggtagttggatgcagtcacagatgtgctagggaatgtggtctagggagcacagtagtgagtgctgctgagggtggtaaggggttaatgctgcaggagagaggtgagatgcgtcacaggcagctcattatctgatgcagtctatgcagagtttaatgttagaaataccagctgcgagtgcccacactctgcatggcattctgtaatgcatttgattttactcctcacagctaaggtattagttgggttacttttgctgtaaaacaaacaacttcaaaatcacactggcctaaaacaacagatatttatgcttgtcttccacatgtatgttgatcagctgagcttcatctgggctgggctgggctgggctgggctccaggctgatctgggttctggtggattccacggcttcgcctttcttcttgaacaagcggctacccatctatgagaacatagcagaggggttcctaacctgggctttgatggccccctgggattatttggcaatgtctgcagacatttctggttatcacaactcaagggaagatgttgctattggtatcccatggatgaaaatcagggttgctgtgaaacatcctacaatgcccagaaaagtcacccaccattaattatctggtcccaaatgtcagcagtgctaagactgagaaacccaaaagcccaaggcaaacttctataaacttatcactcatcctgaactcgagtctggaagcccacataaggtaggcatggcatcttaccagcaagttctgttgaaagcctttgctggtgtcacatctgcttgaatgtgatacaagcaaagactttgaatgtggaacttaccagcaagctccaaggtcaaagcctatgcttgtgttacatctgcttgaatttcatcaaccaaagcaaatcatagggccacatctaaagtctttctggttgggctttccatcctggaatccacgtttgctgggggcacttcaagctacatggcagtgagcgccagtcaagtgctgcaagtaagaatccagtactttgggaggccaaggcaggtggatcacctgaggtcaggagtttgagaccagcctgaccaacatggtgaaaccccatctctgctaaaaatacaaaattagccaagcatggtggcatgcacctgtaatcccagatacttgggaggctgaggcaggagaatcgcttgaacccgggaggcggaggttgcagtgagccaagactgcaccattgcactccagcctcagtgacaaagcgagactctgtctcaagaaaaaaaaaaaaaggaatccagtctgccacatcaatgctccccactcccaagtggggaaactgaggatcacaaatacgaagtaatctgctgaaagtcacccagcttttaagcaacagggcggggactagcacccaagttttacttcacatccttctcaggtggactgcactgcttctgcttagatttggcttgtagagtttagccaaaggaaaaaccactggaggaagctgtagtcagcctcagttttccctctgtgaagtaggggtaataatgatacctatcccatagagtaactagaaagattgaaaagatccagtatttgtaacacagtgtctaaaacatactgagcatttaataagcttaagctgctgctgcttttgccattgagaaaagacaagattatgtagggctcatttccagtaaggaaggtcttactgtgttttcctgagtgtgggttgtctagggaaattgggcccctttctcttttctttaaacttttaaatctaatcactccattttcttgtgtctttttggtgaactctagtatttggaggctttctggccttcagctattaattaaagtcatttctactgttaaaactgaattatctgtttttcttcttctaaaagcaatgaaccagggattcacacagactttaggcaatcataatcttctaaggtttgatttgaatgaaagatcccacatgaaacctgattctgtctgctacacgtaagctgttgctttcattctgttactcaaaattggcctaggacatctagaaaggaatctctgtggcacgttgatgcctacttagtggcagttcgtggctttaatgagtctgttacacagtgcaccttcctcctgtggcctacggaaatcgaaggagggatttgcttggtgggttccagtatgtatttctgagtctcagaaggtctgccaggaacaaatggcgaggcactggtattcggataaaagcagttttctctcttagtgaccagacaatggtgctgtctttcttttgaagtcactgctgggattttatgggcatagttgatcgaatcctgtgctagatgctagaaaatcagagatagggaagaccttgtccctacctctggagagctcacaggagtaaaaaacaaaaaaagcaaaaatataataataataattcaatcattattcattaagaaatctatgaaaatatatattatacaaaatatatatataacatatatatacatagacacgcagtaaaatagatgcacctgcaagtgaagcttaggcatgggttgaaggatgagtaaaagttctttgggcaaacatcttacaaagtaatattcttttcttgctgcttgttgtctcttatagaactataatttagaaagatattttgtattgtgatgctcatgtttacctactaatgtaataatttctgttgtcttttaaaaatattggcatgtttggatatcaaatatttgacctctaggattctctttggcattccttccgaaggcgtttattcctcggtgtttctctgccagcaaaggtagcattccggttttcctgtttgagatgcagacacctagatgtcatcaaagccagagacggaaagcagctgcagctatatccagtgagctggtttcttttttgccaacctaagaaggctttgttgttgttgtttctaggcatgtgaaaaacaggccgaattgaatatcggagaacagtaaatcacgactttacgatttacttcttggagagaaaaatatgaaatattgaaatcctcaatatttttcatttagaacaaggagaataagttttaaattactaaacaaaactagtgataaaggagtgtagcgagtttcataaaacatcatgtcatctatgcaaagttgtgacaggaacggagaaggaaaaaaatatgctgggtgaggaagacaggtgacaagaaaggagttgtgaatggcatgaagaatgagaacacagggaaagcttgaatgggctctaagtgaataatcaggtcatagctaaatttcaggggataagtgaacagctcactgtttcagttcttcacctgctcgttcaaaattttcaaaagcccaacgtaaatgaaatgattaatacagcccacagacagtagacgttaggcatcatggaaaaacgaggttctaagtaattctaggattattctgcagcacgtgacacaggtggtcacacctcagttagacttggactgtcttggactgcccgtttgtttatgagacagggtctcattctgtcactcaggctggagtgcagtgtcatgatcatggctcactgcagcctcgacctctcaggctcaagtgatccttgcatctcaacctcacgagtagctacgactacaggtatgccccactatgcctggataattgttccttttttttttttggtagaaacagggtctcattctgttgcccaggctagtctcaaactgctggactcaagtgatccttccaactcggcctcccaaagtgctgggattacagatgtgagtcacaatgcccagcatggattgtccttttcagacccagaccaaagaacaggacttattgtcccaagaccaatctaggaaaagtataagctgtgttgtcacccaggcattgctagaaagtggtaggctggacacaggatgaaacagttgcctgattttaaagtaagagaaatagatcaaaacaaatgacagaaatcagataatcgtctaaaaatgtttattacctatgagagtgttttcttgctcacctcaattagagcaaacaaccactatttctacaagaacagatttttcccccattaaaatattctgaagataattttgttcagatcatcagtgctgcaagtcaaaaaaggaggaaatcgggctgcttgtgaaattctcttgtcattagttccggttgcttattagagtgtgtagaccaagcgcaaggaatgagaaaaagcacacatcaccgtcagccaacaatcagccacaaagtggagcccattagatctctggcttaggctacgagagttggaagttaccgaacagattttagggatggaagaatttaggaactgctgtggaataaacctgagaagaagaaaagaatcccaagaccaaaatcttagtctgaatgtgaagtctttggaaaatgctaagtaatgacaaatatctaaaggaaactgagaccatgtgatgctaccaggtgatagtttaatgagaactgaaggttaatgaaacatttcatagagttcattgatgaagtatggaatacaaatagaaggagattgaaattaagggggccttcctgatgtctcactattttgaaaactagtttgtgctaagactgagctggcagacacagacatcaatctcttgtgaaacaattgtctattattaacgtgctaattcaggtcagatggcctggaattagtgtctcaagttgatttccttttacaccacttcctttgcagagctggacagaaagctcgtggcaatgtgtactttaatggaattaattagtatcacagcaagttgatcaacttggaggcacgtcactcacccttcattggcatcggaattatttaagttggcgcggcctctatgttaactacacagttatttttcatgcaaaatgctatggcattaaagacaacgactaggctgtcatacctcctcatttttttttctggaaaatatggaaatctggaatttttttttttttttttttttgagacggagtctcactctgtcgcctaggctggagtgcagtggcgcaatcttggctcactgccagctccacatcctgggttcacaacattctcctgcctcagcctcctgagtagctgggactacaggcgcctgccaccatgcccagctaattttttgtatttttagtagagacagggtttcatcgtgttagccaggatggtctcgatctcctgacctcgtaatctgcctgcctcagcctcccaaagtgctgggattacaggcgtgagctctgcgccgggccagaaatctggaattttgttaaacacttctgtcttaaggtgtcagcagacaagtttttaaacatgtgaggacaaattctgtgtgactatcttggggccagattcagtccatggagcactggtaggtgggagcctggttcagagccagagtgagatggtgagaaggagccacagaggtagctgtgcaaggccactggagacagcagggacttcagcagggctggctgcagactggaagtcacttaataaaaataactagcttaaggaaaacaaggggctgttactaggaagcccagagccctgggatcgttgaggggggtcaggagcacaaagaggagggaaactgaggcctccagctacagacacattatgtcgatgagattagagcctttggtgttgccggctggtgtctctctggagcagcacttgctaccctccaaggaagtggaaatgatttgcgaggcagagcgtgtgcaccctgcagtgagaccattgcttcagtggttatggagcagccagagaacataaatgaactgctagctttaggggatattactgtggtcttatttctccaaaactaaaacgaaaagttctagtgcactcactcggtgatgattcatttgttcattgattcatttctttcatttgtcattcaaccaacaaattaatgagcacctcatatacactagacactggggagacagagacaaagccatttttacacccaaataattgaggttcttatgggggggtgcagcagtatatacctgcacacagtgtcccacgggccatcatagaggtctctgcagtgagcagggggtgcccagatgaaggatgaactctgggactgtcaagaaacctggcagaaaaggcaacatctagacgttcttttactaatgtattcaggtttaaagattcatccggtctatgactctacagtcattataatgtcaggaccatctcctactttctcagtacctacaggttataattaatcattggtgttcacaacaatgattccaaggccgtcaggaactagaaccaccttctgattttttagagaaggatgacactttgttatttaattgatactgagtgtttatcgttgacttttaattctgagaaacctggcatccccatggaacatactactctgaaaagtactttcatacccatttgtttgattggccccctaccctgtagggggccacaggttactcttgctatcgtgcaaatgagcgaatggaggtggtggttagcccacggtcccagaatcaatcagctacacctgtggcagatttaggattagaatgaagacctccctacttctttctttctttctctttcttttttctttctttctttctttctttctttctttctttctttctttctttctttctttctttctttctttccttccttccttctttccatctttcttgttttctttttttcttttttttttaagagggagtttcgctttttttgcccatgctggagtatagtggcacgatcttagttcactgcaagctctgacccgcctcctgggttcaagtgattctcatgcctcagcctcctgattagctgggattacaggtgcctgccaccacatccggctaatttttgtatttttagtataaatacggtttcaccatgtttgccaggctgctctcaaacgcctgacttcaggcgatccacctgcctcagcctcccaaagtgctgggattacaggcatgagctaccgcgcctggccaaagacctctctaccttaaacctctggaaaaaaacaaaaacaaaaataaacaaaaaataaagcaaaacaaacaacaaactagaacattttattttctacctgtctgaataagcagttttcttcaccactattccatacaaaaagtgaccaccatagtacaggccatcacactctccctgcacccctctagtagattcttcactagcccatacagtttcctcttgttcctctttagtacattctttctacatgtttcagaaggatcttcgaaaattcaaatctgagatagttatttcctcaccatcctcccttacctcttgaccccttagaggttttaaacagccttattaagatataattcacacaccacacaattcacccattgaaagtgtacaattcattggtttttagtatattcccagtcatgcaaccatcatcacaggtttatttcttcttcttctttttttttttttttgaggtggagtctcactctgttacccaagccggagtgcaatggcacaatcttgggtcactgcaacctccacctcccaggttcaagtagttccttgcctcagcctcctgagtatctgcgatgacaggcacctgccaccatgcccaactaatttttgtgttttcaatagagacagggtttcaccatcatggtcaggctggtcttgaactcctgacctcgtgatgcacccgcctcggccttgcaaagtgctgggattacaggcatgagccactgctcccggcctctgcagtcagttttagaacattgtcttcacctcaaaagaaaccccatcactcttggaagtagcatccaacaccccctctttcctatctctaaacaaccaccagtctacttcttgtctctgtagatgtgtctgttctaaacttttttaatgaaaggaatcatgcaacacttgcccttccatgagtagcttcgttcacttagcaagatgttttccaggttcccccatgttgtagttgatgtcagagcttcatcccattttatagctgagtaatattccactgcgtgaatatatcacgttttgttcattcattcactgatggacagttgggttgtttctaccttttgactattatgaataatactactttaaaatgcgtaagtgttttgtgtgtggggacacatgtttttatttctcttggctatttgtctaggagtggaactgctgcatcatatcatatgctcactctaggctgaactatttgaggaactgccagactattttccagttttaatgctgttacgttgcccttaggaaagagatcaaaatgcttaacattgtttacagggacccatctgatttggccccactcacctcttcaggcccagcccatgtcacctttcccacttctgtcactctacttggtccccctggattttgtgcagtttttcaaaggtatgggcatttgctaaggctgtctccctcctcttccccatgaacttccatcagacagaccttctctgaacagccttcatccgcaatctaaatgggatctcgttattatattcttccatgtttcataagttcttaagtgattcttctttaatcccactaaatcatgactccagatgagtttaagaaatcttaagactattttttaattattacaaaccaaaagtctcacactgaacttgagctacaataggggcaccttatctatctgttgaatgaataaataacaatgagagagggggagggaggaagagaaattagtttaagaggcctcaggttgccacgttgggtttgaaatctagatgaagattgacatttcaccccaaatctttaactacttcttcctttttcactgagtaatatagcatatgggttggaaaacgttttctgtaaaaggccagataacaggtactttaggccttgcgagtcatgcagaccctttctgctgttactcagttctgcttttctagcacgagagaagccgtagacagtagatacatgaatgagcatagctttattttaatactttattcacaaaatcaagcagcagcctcgatgtggcctgttaaccataactcgacgacctctattctagagtattttgatacttgataccttcacgctctctgttttctctccccagaatcccatatttccttccacctttgttctcctagaagattcttctcagggaacaaataccttatttagaaaattttccttgacctgcaaaacagaattaaacacactctatctcatcactgaatgaggcatattcttatgttgctgcatgccttcggctgtgttaaattaattgaatatggactcacttacagaacgaagtccacaatgtcccttcttctcatccagcatcaaatatgtgatatgctcagtaaatgctaaactgaaagagaaaaaaggtgacatgaaccaaatggattatctatacaaagtacgcaggcaagcagatgatagaatcaagactttaaaatagagggaaggagaaataagtcatctgaattgatagcaataccagaacacagtattggggataagcccagtgtcagtgtgcagggtctaggtcttttattcatctttccagaacatgagatttttttcctctttttaaccagaatttttcgccggacaacaacaacaaattactttattcttcctggaaatttcttggtagcaatgcctctgccaacatgtaccatacccatacttcttctatcccatcactatcttctctcttacctggggcatattctttaaggggtagcataaatcattagtatctcaaggattggagaaacatcattgtcctaatgattcactaccatggacaccacacttggtgctttttttttttttttttaacttttgaatgagaatattcctctgaactctatgggagtacaatatttgtttatgtgtgacctacaagaatggcaggactatatagttcaaccgaacaaaattcagaagagaagggagatgactcataaattatcagtgggacttacactttgcctggtagtggcatgcttgctgtgccctttgctgcacaatctaggtggtgggtaggactatatttacactttgtctctgcatggcccgcaaacatgcagaagggatgttatgagcaaaggaacaagtcactaagacactttaattctgggctggccaggacacttaagaaagttggatgacactgtgccaggagagtctagaggtcctataacaaagccaaatgctggctggttgtcatgtgccctgtctgtactcctaagcccagaacctatgcatcagtctgcagtgggggtatctggccaaaggagagaaaatggtgcaatatgtgttaagtccagaagaaactaacagaatgcatctcatccggccacagtcatgtctggctgctgaagacctcttttgtgcacaagtgaaagaaaagatgttgagctagggttgtaagaatggcagagggatttatgtaagaaatatgagtctatttccatgacttgtgtcatttataaaggcagggacagatggaatcacttcagtgagctagaatttgtattaagttctacttgctttattttccttcatttacatatgcttattagtaatacacgtgtgagaacaaaatcatatactatcagtcactgccacacaatgaataatcccatgtaaaatatttttgcacacttttgagagtgacaataacttcactgagcttggtttcttcctttgaaacaggcagacaggcttttgctgaatctttaatgcattgtcttttggctgggttcattcaccttcagggaattctcaaaagacaagcgtcatttctttttgtctattgatctgtcctccagaaaaaagggacttctttataaactcaaagcccttagctaattcattgttcatttgttacatttattgaaaatctactgtttgaaaggcacttgttctattgtgctatggaaacaagacagacaaattcctagtcgttgagagcttaccttctagtaggcattacagaccagaaaaatggctgttcagtaggcctgtagcaataagagccgtgaaaacaaggttgggattaaggatgagtaatgagaaggagttactctttttgatcaagaagtcaaggaaggtttctgttttgaggacagacgtgaatgaaatgagggagcaagtcatgaaaactctttggaaaagaaaaaagtcttataggtgaggaaccagcaaatgcaaagaccccaaaataaaaattaacacctggtggctgggcgcagtggcttacgcctgtaatcccagcactttgggagtccgaagcgggtggatcacgaagtcaggagatcgagaccatcctggctaatacagtgaaaccccgtctctactgaaaatatgaaaaaattagcagggtgtggtggtgggtgcctgtagtcccagctactcaggaggctggggcaggagaatggcgtggacccaggaggcggagcttgcagtgagccgagatggcaccactgcactccagcccaggagacagtattgtcaaaaaaaaaaaaaaagaaaaagaaaaaaaattgagacctcttttgtgcacaagtgaaagaaaagatgttgagctagggttgtaagaatggcagagggatttatataagaaacagaagtccatgcttggaatctcagctgttttctagttctcagaatttatgagtgagattaaaagagaagcttcagagtgaaataaaaattagcttagctatcttgaagaacaccaagaaggaatatgtggctgaactagaatgattttggggagagtgaaatgatcaaagttacatccaaggttcacatcaggaccttgcaggccacagtgagaacttagaagacaattgacataggatgattggaaagcagaatactgaaaggccaatttacgtattcaaagatcgtgtggaaacctgtgtggtgaatagagtgggaggacaagagcagaaagagcaactcagaaacaatttactaagctgggtaagagatggtggcttggctgagaaggtaaccagcagatgatgagagatggtcaggttcaggttgtagtttgaagatatagctgatggaagcagctgatggagtggatgtgtataaggagcattgggcaccctgttagcaggctttaggcttctttgactcaggcattgtaccaacattcacctagtagctgatgttgattcctctctcacaaagacagtatcttagtttgaaatgcttaagaaaaaaaaatgtacctgatccaaggggaaaatggagctccacactagcagggataaaaggaaggtggttctgattatttgtgctgctcatttccatgaaggtcttgttcacagtaagcaagtttgtcaaacctatgcctaggtagtcaaatttccctaaccagggatagtctctactgggccttagcaccttccattcagtaataaaatgaggcatcttgagcttccccgaagcacaaatctctgggccactgtatcagaattatgtgggatgagttaactcacagattccggagaacctactaaatgcttgtggttgaatttcagaaatctgcattcttgcagttttcagatgaatcccatgcaaattaaagggtttcttgttttgttttgttttgtttttgagacagagtccggctctgttgcccaggctggagtgcagtggcacagtctcagctcactgcaacctctgcttgctaggttcaagtgattctcccacctcagcctcctgagtagctgtgactgtaggcacgtgccaccacacatggctaatttttgtattttttttttttttttagtagagatggggtttcgccatgttggcgaggctggtctcgaactcctgacctcaggtgatgtggccacctcgatctcccaaagtgccgggattacaggcgtcaaattaaaggtttttgattgtgatgaaaaacacacataaaatcgatcagcttcatcattttaagtgtatatttcagtagtgttaaattttttcatgctattgtgaaacacatctccggaaccttttcatcttactcatctgaaactctatagctaccctttgccccctttctgtgtccttgagagtcaccattctactttctatttctggaaatttgattactttagagagctcatataagtggaatcacacagtatttgtctttttgtgattggctttatttcagttaatataatgtcttcaaggttcacttatattgtagcatgtatccaaatttcctctgttttaaaaactgaatagtgtttgtattgaatgaatataccacattttgattatccattcatctgctaatggacatttgggttgtttctattttttaaccattgtgaatagtgctgctatggacatgagtacgcaaatatatcttttaagaccctgctttcaaatcttttggatgtatatccagaaatgggatgcaaattaaagatttaaaagcattgccttcaaatagaagagattcttgtagaaaatgaattattatgtatctggactgtggtggtggatacaagaacctgcacatgtaataaaattatgtataactaaatagacacacacatacacatgtaaacacacacacacatgcacacacacaggtgcaagtaaaactaaggaaatctggataccagaattgtataaatgccaatatcctgcttgtgatactgtcctatagttttgtaagatgtttccactggggaaactagaaaaatagcacatagtttctctctgtattatttcttacaactgcacgtgaataaaaaatgatctcaaaacagaaaggttgcccttgaggttagagtgtgccactgcaagaggagacccatctagaagggcaaagaattcttggcattgttccgaaggagaaagtggaacagggatagaggccaacccaaagtgctaagttaactctgggtcccaagggacatggcatccccaaccccagacagtaggaccaatgtagcacagatagggaaatggcagggaatgagagccagaaaaacagaggccaactcagtactgaatccccagagtgtgggcctggagctggtactgaccaccttcctcagattgcactggtcctgggaatggggtggcgtggggtccatgacctcagcccaaatcactcctcatacgaaggttggaacaggggacttggtcacatgagccctatgcttcctcttaattctgaatgagtttcagattcctgcaggcagcatcagcaacatgcaaaagacgcttcttagatgcttgagactgtaaacccttatcaggaacataatgcgatgggatgtttctctctctttaggcaaaatttaaggatactggtggataatatttacttaatgattgctatgtggcaagtgttttgctaaatgctttacaaatatttattttctgtgagatggttcctgttcttccatctcaaagatgaggaaattgagattctgagaaggtgactgagtaccttaaacaatcacacagctgataagggacggacttgggccttaaagtacagtctccctgaatctaaaacccacctttggaatctcagctgttttctagttctcagaatttatgtgtgagattaaaagtgaagcttcagagaagaagcagagagtgataacagcgatggctccaaaaataaagctgaggagaccaagttctgtcaggtgcattgagactctttttataatcccaaaactgtagaactgtaaagactagaaaagccagccacactctgtatggtactataatactgatgatgtcctatgtacttaatgtgtgtttctttctcattaatcatcaatgctgagggatgttgcatgtcttagagtttaacagccacccatagctccccatttgtaataaactctagtcagtgtgtagtcactgcctgaacaagttacaatcttaaaataaaaaccttattgatttcttttttaactttgaaattaacacatgcctagaaaaatctagaaagtatagcaaagcaaagaaaaatcactcaataaaaccactgttaatattttagcataatcttgatagtggaatgcctttattttttaaaaattgcattatgtatacactagttttagtcagaatttgtacttcttaacatgcatactataccattagtatatttttacattctctaaagtgtgtctgcaatgcagtgttgtactttctgcagataccatagtttctttcatcaatcttttataacattgtgttgattgtagttttttctatctttaagcaatattgtaatgagtatacatgttgctacacacatacacacacaaccacacacgcacatatcaggctaaatttctacaagtgaaattttcaaagcttgtgatgggtgttaacaaattgcatttcggaaagattttttcatgtaattgataatatatgagagtttatttcctcataagtctgtcaaacactatgaactttttctaattattgtaacaattttataaattgttacaatatataacatgctataaatatatgtgatgcaaatttttttacagttttctgtttattttcatataatattttagttgttgtaaaacctgcatttcagtagtttaatctgtcagtaattcacgcaataaattagagctctaatggtggcttagaagggccttctcccctgtattacttaaatattcaatgactttattcctcctaatacttaaatccatctggaattcattagactatactttaaatttgtatgtatcaaccctaatttttttaagaacatcatgtttgataaaacacattttaacacttacttaacaaaatgactttaaaactgtaaacttaaaaaaaaggtattgcatttatttctattcctctgaatttcacattaggaaaggaaaaagggcacgtaaaaatacaatccccagtaatttctctctgctggctttgttttctaaagtattatatttcccatctttgcacaaaaatccccttaacccttgtacatatccttaatagatctggcataattccatcatccaagagttatataagttctacttgaaccaattaaaatttttagcctgtgtcacctcttgaggcagaggatattcactaggactttactcaagctgcttacataaaattattttgaatatctgcatagatttcttccacataattaaagttacttcaaaagttaaatgtttaagaatgccctgaaagtctagtgtgattgtgagcgtgcatacacataagaaaaaatgttttcattatgtttgatgaaacaaaaattttaaagtaaaatttcaaattcataaaggaaatactgtacctctaagcagagcaggattttcaaagaacatttgataatagtatcaagatctttaattaataacctaacaagtaggaaacttttatcgcccctttgatcgtttttataaggagatataaacaccacatccagtctgtcaagcgggggataaatgaaggtggaggaatgttacaaagggcttaaaatgtcttttccctgggaactctctaggagttggtccgtaatgacatttaacttgaataagtgaaataaaactaagaaaaatagcttgaaatgcaagttgttggcgtcagagagaaacctggattacggtaatagaaaagcaatttcaaaggaataatggctgacaaataggaattgaatctagtatactgcatccacatttgcaggtttctacataaagatctactgggaatgactgatttccttacggagcgggggtggtcctatggggatgattggcacctctctcagattgcccagcctccccctgctcttctgggagactgtcagggtgctgctctttggactacctttgaaatcttgacctgtgacgaggctgtggctggtagtgatgttgccaggaagatggcattccaaggtcaccatactcccgctaaggtctaacaaagctttgtttagtatttctacttgctgggaatttctgtgtacacatgctcatttatctttttatttatttaacaataaaaccgagagtggtattctaaacaccatatgttgctatggtggaaactaaaacctggaaagctgaagtttcttagtaagagagcatgatcacatgacccattttgcccaggacagctttggtttgcacctgttgtttcggcttcattgttaatggtacctacttttattctaagaagattctggtttggacaataaattatgtggccactgtattaatgtcctatggctgctgtagtaaattaccacacagtgactcaaaacaacacaaatcttatcttgcagttctgtaagctgagaatccaacatgtgtcagggtaaaatcaaggtgtccgcagggctaccttcactcctggaagctcttggggaaaaacccatttccttgccttttctagcttctaaaggccacgcacattcctggcctcatggtacctttctccatcctcaaagccagcaacagctgttcatgtccttcacatatcccatcactctgaccttcgcttcttcctccctcttaacgactcatgattatattgggcctagccagatgccatataattcatgctagtctttctgtctgtctgtctctctctctgtttctctctttcttcctcctttctctctctctccctctctctcccccctctctccctatctccctctctccctttctccctctctctctctctctctctcacacacacacacacacacacacacacacacacagaatctccctctgtcacctaggctagagtgcagttgcacaatcacagctccctgcagcttcaaccttccgggctcaagtgatcctcctacctcaccctcctgagtagctgggagtacaggcatgcaccgccactcctggctagtttaaaaaaaaaaaaatacagagatggcagtctctctacattgctcaggctggtctcaaactcctgggttcaatcattcctcccgccttagccctccaaagtgctgagattacaggcatgagccaccatacctggcccaatctctgttttaaagccagctgatcagcaaccttaattccattggcaaccttaatttgggaggtggagagagtatgagaattgtagaccgaaacttcatgaaaagatttatcagtatgtctttgtttaaggcactaaattttagaaaggatatgtagatagagtactcttacccacacatcgtgatgatctaattggaccatgagtatattttcatctaaatctgcctaccaagcctgtacatatattgataatatattcatatgtaaggactcaggtgtaaaaagtaagggcaatgtaagtgtcacattaataaactgggttaggattaatgttatcatttcctgtcttatcacaacaaacattgtatccatggtggaaaatatcacttaaaaaatcttccaatcacactctaccttgcaagattatctgttataaataaacaatatagtatactgacacaaaaatctttgtgggcttatttccatggaatctctgcagaattttgttttaagctttgaacatctctgtggttcttgagacatactttcagactgccttccaggaagattgtatcaagttgagattccactacggtgatccttgtgtttgtgtcactgtacccttaacaattaccggctcttaacttttctttatctgggggcaaatgctggcatgttatttttcatgtgcatttcaaggttttgtgtgagtcaaacacacacacacacagttcctttgtctgaacttacagtcatgtttagctggagagatggcagtgttaagacttgtacatccctgcttacatgtagtgagcttctgatgatcattttatgtttcttgccctaagggaggagaccatccctcatattgtcttatgcccaatttctgcctccaaagaaggaaaaagtaaaaactaaaaggcagaaatgaaatccgcaagcagacggcccagcgccacaccctgggccttgtagttaaagattgacccctgacctaatccgttatgttatctataggttacagaaattgtatagaaaagcactgtgaaaatccctatcctgttttgttccgatctaattaccggtgcatgcagaccccagtcacgtaccccctgcttgctcaatcgatcacgaccctctcacgtgcacccccttagagttgtgagcccttaaaagggacaggaattgctcacttggggggcttggctcttgagacaggaatcttgccgatgcccccggctgaataaaccccttccttctttaactcggtgtctgaggacttttgtctgcggcttgtcctgttacagccctacagctatattctattactagatatttggggccaggcatggtagctcacacctgtaatctcagcactttgggtgcctgaggtgggtggatcacctgaggtcaggagttcgagacccgcctgaccaatatggtgaaaccccgtctctgctaaaaatacaaaaatttgccaggggtagtggtacatatctgtaatcgcagctactcaggaggctgagacaggagaatcgcttgaacctgggaggcagagattgcagtgaaccaagatcacgccactgtactccagcatgggtgacagagcaagactccatctcaaaaaaaaaaaaaaaaaagaaatttggaatgaaagcaatgagattccttcttgtttgtgacttatagacgggttccaatagaagtttctgaagaggtattccagagataacggcagtggcagcatctacgctaaaaaacattttagtgccccagagaggtaattcggagggaaaatacttattcaggtgagagatatcttatctgtctgcaaaatagaaacggagtcacattgtgttagagatgtaactactgtgtgctttgattctgtgtgatttgaaaacttacatctgaaaatcctgtgcacacacaatccattgatcgaatgttgaactatatcatctcaaaaaagctctgtgtgtgtctgtgttttgctttatttgcatattttgcccaaagaagaatcatcagagttaaagaggtcatcaaactgttttctaaatcatttctcttcggaatgactcacaagtccatggactgtgtgtcatgctttgtttctgattctgttgatctagattttgcatgtgttgcttgggtcatctcatattacaaaaaatattggcttttaagagccagcttctgcattttggccttcacccaagaaaccttgtaacacattttgtttttcatcagtacatccctttgggtaagatctcagtgtcaaattttgtcggactaaattgtgtctttcatggctgaagatgagaggatgactcaaatgaagggcaagctgttaatagttcgccatgaagctgaaggccacgcaggctttgtaatttggttcattatgttcttgcatttttaagggattcttttcaaagcattttacgtacagccaattcctattagtgtggtgaattaattggcttgaagaatcattgttttgcgtactgtgacttgatggttcacatttctactggatacctgctcacccaaccccccacagtatggaaagagagtagaggaacccaggtgctgggatgccaggaagggtggacaacagggccctaaactcaaggctgaaactgctctccaacttagcttcccttctggctcctgtggtttttctttagctccttctccatttcaggagttgagccccttttttcctcccattctcaggactcagaagatcagggctaacaacctagtgcccatctaccatgcccccttgaagtacagaaaatattcaggcggtatcttagtgtctccacctttggataaagtatttttgctttaaacaaattagaggtgatttgcatcctctgtctccctcaccatattattcactgttgtcatttgagaattaaattgacaagcgtatttttttttttttttttttttttttttttgcttttcagaaagtgtgtagtgtcatggaaggaactatgtggtagctaggctgatactataatatttcgcagcctttagtttgtggcaggatgctacataatatacagacgctcattgtgtggtttaatgtgtagcttcatgtgtattaataaaaatatataagaaactcattaagctcctcaattcatggatgattttgccacaaatgaggcaagagtaaaaagtagcaatcaatgtaaagcaaagctactaagtaaatagcttagtaaagataatgaaacaaaaaaaatgtaagggagtccatgcaaaaacattcagcaagtgtgagcacagtgaggggaatgtgagtgttacagtcggacctaagtttgagttcaggctgatgacaaatcagctttgacaccatggaccaggtccttaaatttctttgctgcgatgagtatttgttcagattgttttaagccaaatgagacagtgcaaaaaaaggccagacctgtatgggacaccaaatcaatgttagtcctcttctttttaaaaaaaaaaaaaaaaaaacaagtaatcagtttaatgtactctgatattgtttaccactgggattcttcttcatcatttaaggctacagagtccaccagcctagagtccatggagtcagaccaactgtcagctgtaatatgccggagatggagagaaaggacagatggccagagctcaggccaaaactttggattccagtctcttaaagaggcatagcctcttccaaagagggctctctgcagtcaatatcatatcagctacctgtttggcaccaggcattgggtccaggcttcaggatttgctaataaactcccgtcctcatgtggccagacagagaggtagacgtaaattgaattatcacaccaataggtaataacccatgggaagtgttacaaagcaaggaggctgacgccatgggaatgtaagccagggacaccctagctgttctggaggagtaagggaggctcttcttgatatttgggccaagatctgaaggatgaatagcggcagcaaggaagcgtaggtaggaaacccatggttggtaggagggttgtatgtaaaaatacctgcaagaaaggatgtgatgagttggaagaactgaaaaaagatgagtgtaactggataataaggaagaagagggattccttgtaacatgaaatgagtgtgaggaagtgggctgtggccagattacagaaagacttgtcaaagcaaaggtatttgctgtttttcctaagagtgatgagaaaccattgaaaggtatccaatagagggtgacataaatcaataaacattgacaaagacaccctggaagccctatagaaaacagatggtggcaggcagtcatggctgtgcaggaagacccacagggcgccttgcacagtagccctggtgagaagtgacagaagctaatctcaaggagtgttgagggggatggagagaaaaggggacattcaggaagtgaaacaatggatgtgggcaggatatgttgatagagtggctgcggatagaagagaaggtttcatttgaggaagagaatgactcatgagtttctccttccttgatccctgagagaggagccatcctctagacaatatttagagcaaaatgataaacatgcaactgtatttatcatactttctggttgctcaaaaatccttgcctccaatgatgtcaataatattttaattaagttattataaatgtaaaatagttttgccctctctaggaaaggataaagctgggcccctaaaaactggggagtaatatttgacttcagactcagtaccagctttgtatcagacactttcatgtgttattttagttaatctgcaccaagatcctgcaaagtcaccatggtgggctcttattaataacacaaaaaccaggatacggagaggtgcatgctctgctcagggcccggatctggtgtgtcagcaggattcagtatcaggtctcctgaatccaggtccagtgctctttccacagctccttaaagccctccagtcagcctttcacagatgtcccccacctccagcaattctcccctccacctctcccaccagtgcaggtggcatctggatctccctcccatgatcagccaagctttccaccgtgtgagcaggaaaccactagcactagaatctctcaaagtgctggtttaaacataaattcctaaagaatctgattttacccacttccctggatgatccataggcccactgtgataaagctgaatgagttactcctccctgggatatttcatctcaatggaggaaaataattctgttggggtccaaaaatcacaccaaggctaaggcaatacagggccccccaacactcatcaccattctctgtgacctttcccatctctgggacctctccattatactttgttttctgcaatgtttcacttttcaattaataaccaatttccttctacttttgtatttgacagcttctcaaaaagtgatcagacaaaatatgatttttaagcattcagcatgcacagttgaagattagaaggacattggaaaaaattgatgtttatgggaaatgtatgtgtatatttgtatgtgtgtgctatgtctgtggtacatgtacatatgtctgcctacatctgagtgtgtgtgtgtgtgtgtgtgtatgtgcgcatgtgcgtgctgctccagatagacctacaaacatctgtcttcctggcctgtgtacttgggagtggtgaatgagtccaacagccacacagtgaaattcctagcaggtggcaagactcagcctcctgtttggagcttattttattttcctatagctgaacctgggaatacagttcccaaattccacaagacccttggatttccatctccaacccctgtgtctcagtacaacatcactcaaacagtaatgtgcacccgaattctctagaaacaatgttaaaatgggtttcctctgtaggatctagacaggaccgaggagcctgcatttctaaccagctcctgggggatgccaatgctgctggcttggagactgacctttgaatagcaaggtactagaacacacagcacagacattggtcagatgtgtaattgctcggagttcaggctacctactatggaattagttattaaaatcctgcaacattggataactgtttctagctgtcatttgttgagtgcccctctcatctgcctccacagtggactttttttttaatatcacaccttgttattcccatgcaggtcaaccattgaatctaagaatagaaatcctcatgtctgaaggggtggtcttgaagtaggcaatgagggcctgggtggtttccatttcctttgagcaagtatttcattgccttctgccatgcctacctatttgtttttctcacagtaggtttctaccaagtggcatctcacttctaacataaagaacaagcatcagaatgcctccctttgaatgcatatgaggttgttttgtttttagaacccaaacacagccacttgaatctatcatgtaattcaaaggaaacaagcattattccagtcttttcaaactaaggttttgtgtgctttgggtatttcaattaggaagaaagaaggcaggcaagaacgttattgaacatttattctctgatactggaggatgcgctggaattcaagagcctgacttcagaaagtttggcatttgctaactgtgggtctgaccttcgtatgagaacagtgatgaaaactcacgggaatgtcagattttgttacggtatgtgattgggtggataaggctgtatttactaacaacttcctcatgcatatgcatgtgcttaattttcatccacatcattaataagatgattttaaaactggatgaacctctgcataaaacacaaacatttcctattatatattttattcagtctactatgttttcctctgtggggatcaagcatgatatacttctttctcatctctgccttcccagggactcataggaagaaaatgtcttcattcttcacttggtttagattgttctacgcaaaaactcttgtatggacataagccttaacttactccattcggagttgagcagagtcctaattctttgacttgatcttataccattccccactcctaaattagttccaattagttccaagttcatccttacctcagagtctgctattgctattcctgcggtctagaaatcattttccatgtgttttgtatggctatctctttccactttcttgtcattcaagcctcagctgaaacattccctcagcaataaggttttctccaccatttattttgaataggtgtcccctgccacacacacacacacacacacacacacacacacacacacacactttgtcaatcatactctacccagtgatggaaatgttctacatctgtgttgtctaatatggtaactactacctgcatgtggctactgagcactcaaaacgttcctagtttgactggagtactgagttttttcattttaataaatgtaaattgcaatagccatatgtggctagcagctacagtattgggtagtgaagctttcgtattcaaacctgtctcatatccttcatagccctcatctgtgactgaaattatcttgttcatatctttttctcttgtttatcacctgtctttccatgctgggttatcttttctgctaaccactggataccagggtgttcagcgtgatggctgacatgtagtgagtcctcaaataatttttattaaattaactttaagaaaatcccacttaacagcccttcactgtttttagagaccattccaaaggtcttgacttgtgttgatattattgtcctctgaaaagtctgagtcaaactctgattagttttgtaacataaaataccattggattgtctgtttgcataattggttttctgagattcagctccacattctgtattcatcctaatcaatggtgtctccttagtttctgtctttctttccattgtgttaagatggatctgttgtctgcccttcccagtttcagcatatttgaatatttggcaaatgtgaattctgattacctatcctacttgtagcttatgatactggccaagtcttatagaatgtagaatcttaggattcagatccaagatatttgttatctttaggcacagtgtttttttgtttctgttttttttttttttttttttttttggttgagttaaagtcaagtccttggctattttgggaagatgaaaaaccagacctatgttattacataaaattgcctcagagctttattttgattgatttcctttgttagcagtattctcataatagcttaaaaaaaacataaaagtataaaatttcactctctgtgagatctcctttgtgtgcagatattacgaggctctgttcacttcattttttcttattacatgcattattttatctgcaccagaaatcaagtatgtatgtctgtgtgtgaatttgctggtaaaaggatgaagtaatgttaaagaaaaaaatttaaaaattatctacccacacatacctggtttcattttgctcactgccttcaaattctatccatatttgtaggtcatgtatgatgatgctcatgttattttgtgtatttttactcaatattctaagtagatcaataaagtttaaaaattattgtattgtaatatgttgttacacaaacattccttcaactagttcccttccactggatgttcaggcagatgccagtgtaattttattttgagaaataacaatgcagtgaatagttccaaatatgtagtgcaaacttatataggatcaggagtggtataaaaacggaacaaaagtatgagtctttcgtggtttctgttgaattttgccatgcttttgaaaaggattatactggtttacaataccatcaggtggaatgtgactctactgatttataacaagaatgtttgtctttcatttttctaatttgggctcttttttgacaatagtattgataataactgtagcaacaatagcagcagttaatattcttgagacatattatatgatagaccatatttaaatgctttagaaatattgtttatagtggttaaaaaagtgagctctggaggcagacttcccaaggtcaaatctggactccaccatttatcttctctttgctttcattctctcctctgtaaaaagatccaaagggttgttatgacaatcaagtgagataatatagtatagagctaaagtaagcactggataagtgtttgttattattcctaataatgagtgtttttgttaaccccacttacagatgagaaaactgagatccagtgtcttgctcaaggtcacacagataggaaagagttgtactaggattccaaatgcagatgcccttttctgatcaaaatactcctatgcggggaccaacacttatatccaagaggaagtattactcttatcgctgagttaaatcaaggttgaattacgcacagaaaatgtgcgcataaggtccccgtgattcactggaaatgccatgacataattcttcgtttccaagacaaacaaaaaagttgtttttttatgctgccttcttcattgagatctgaaagtagttccctatggaagtgattcatggtgttgtgaaatcctccgaaattgtaaacagcctggtgggcaggaatcccgaggtctcattcaggccccctgcaaattctgagttcctagcctgaggaaagcccccaacaaatactgacctgactttctcctaaaagattgccataaacacttttggttatctcttaatgtacttggttcataactgcttagtcaattatttttattagcataacattccttttaagcataatgatattgggaaaacagaaatgatacaagcgtaatttcttggctatgactgtttatgttttgagtttttttgttttgttttaactttctttgccgatttgatgaattaattgtaaatttcccaagggggatctaaagtgaactgatctttgccttttattctggaatgttcaatttctattctagtcccagtgactatcctctgagaccaaaatttcaatattgccaagggctcataaaattgtcgatataacctactttctctagagaaccttatttgaattttcataatgaattaatatcttctttctcccccaatctctttgctcaaatagctatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggtatgtcacattggcttacctttagcgtaatggcttggaaagaggcacactttgatctttgtggattctagggactgtcttatggctgttccaacttgtcagctcgtatcagcgtcgacttaatacttccctgcgtagaagccaggttggaaagctaaagtgcaaagcttgaccgaggtgttgcaagctacggaaatctctttcattgtctctgaagatcatcctccaaggatgactgccatctaagtctctaaggcatggccgatgttgggcaccatgtaaatatccagcttacctttgtgaaagtccaaggctaaactttgtgctatagcagggctttgatgagaattgggtccccattacaaactcctcagttctttcttttcacagtggccttttaataagaactattttagtaaaataggtaggacttcttcccttcccttagaagatgtgcatgaagaaatcttttgtcttcagtcagaggaccaaaaggaggatgtttgatatctctctctggaaatgcgtaaatgcatgtgcctactgttatagaagtcactcaaggttactatagagctcccgctgtcttttcccatgtttaacctttctatcagggacggttttagaatttagagcttccttttttgccccaatacatacaaattaaagtatcccacagccagcagctgaagtcactcctaagtataatgcttgagaaaatgaaagaataaaacagaaaaattcctcttcggctcactttgattttcagctttaaaatacacttgagtgaaaaaaaacaccatattaagagtatcatattaagagtatcatgatactcctagattatgcccaaataggtaaaatagtgattcgtcagaccagacaggagatgagagcggcttttactatttttcccccttttctgaattgatgggatctatcagtgacatgtagatacatgaggctctggaaatgttgccatggtaaccttcccagacaaccaggtggataattgtatgcaagatgcctaaaacctcccgtcagcttcaaggagctgggtctttatgcactgcatcagatcccccaagggcaagagcgaccctcttccttcccagctttaaatgcgctccgtaaaaatgaaagcaaatgcactgcgtgtgtgctggagggtgtttaggggagtgttggaggcagatggcagaggagcaatgacaggtctggagagaaggagagagggcaggtgaagggaggtcaggtcacttcagggcagacaatccacgtggcccctctctgtgagctgcttttgatggaaagatggcttctggtgagaaacaccctagaatttcggtttgatgtttacagaaatcttcttaaacgagctgatgtgcagaacacatttggagaaccaatgaggaaagcgattaaagaggccaaagtttgagcagaacagaaaaatgattcccaattgctatctgtggtactcgggccccatgagtgagtgactagaattcagatgggctgggaaagtgttctaaatgtaaatgacagtgcttacattcgggatggctgtgagcttgcacatgtctttgtatattatgtgtgtatatgattagacggtgtccaattttcctcccactgtgcctgtccttaaagtttagaaaagaatttcagatacatgtaatattttttgatacatgtatatacatgtaatattttttgaagaaagagttctttttgcacattgaattctttatgcacatgttattttgtgtattttttatgtatgttttttgtgtattttttagatagagttctttatgcacattgaatttcttaaatcacagagttattcagttagagacagttctccagcaaaacataaaccacctcaaatatctatttatgattggtattatcctataaaaatacataaagactcaggtgtctgtatggattcattgttttctttctcagcaccctctgggttggactataaagcacgcagtgaaatagaatcagtcagatttgggatccagaatgtggaaatgttgcaaaagactttcaaacaaaaagccacttagattacttagcaccctgtaagagagttgcaggcaagatggcccccgaagcattcatgaggccagtgggaatctgatgaagaagacggtatcctctttccaacctcttcttcaacttaaatcgtttacaagtaataacaaaccctaactggctataaaaatgatcgtctcttgtatttccattatgctctgctcatctgtggctcataggatcccatgtgttgtagaaattattcgacacccactgggagtaagggtgggggtaggggtggggtttgggtgggggtaggggttggggttgggggctgactctggaaagagttccatgattttccatgctctcacaaataaaagatgggagtcagtgcataacctgccttcaaatcatatgctctttcacctgtcccgctgaattcatggtgaacacagccatcaggtatcatagcactgcgtcgagtacttactgtgtgccagcagccatatatgtacaacatcatttcatccatgatcccacttcctgccctgagaggtggctaccactatccctatcttacagatgagaaaactgaacatcaaagaggctcaggaacttgacaaagttacctggctggggaaaaggcacaatcagtgtctacgtctccagcttcaaaatttggtgaatggttgattacttagctggtaagaggctgccacatctgccttaattctctgcaaattctggccacatctgcactggcatcatgctcaaaagactagtccgggtctgtctacaatagcccgcatttcttcctgggccttgtgtgagctacaagaaacccaagaaccagctgggtggagtggctcaagcctgtaatcccagtactttgggaggctgaggtgtgtggatcttgaggtcaggagttggagaccagcctggacaatgtggtgaaaccccattgctacgaaaaaaacaaaaattagccgggtgcggtggtgggtgcctgtaatcccagctagtcgggaggctgaggcaggagaattgcttgaacccaggaggcggaagttgcagtgagccaagatcacgccactgcactccagcctgggcgacagagaaagactccatctaggaaaaaaatgaaacctaagagccacgtgacccactgggtctgctctcttgtttccatgttttacaccacagactctttgcaggcccagctgggggaagtatttgtgcagttctatcagatgaactgatttagatcctcacagaaaatgactagttcttcggatgaaatagccaggcccattgaatcacctctagggttcaacggtgttaagtgttgaggcctttgtcaccactcatgtcacttttttctgagcctacataaccaaaggcagcttcatggggcacagcctttgtggcctcacacagccaagggaacagaagggtcccatgctcagaagggcctggggcttggtttagcgttctgctgtcaccatgttgaaattcttaataattgttgaacaaggtgtctgcattttcattttacactgagcgtcacaaattatgtggctgttcctgctcacagcattgtagcctagagctgtgtttgacgctgtgctcagctatttaacacggtgtgatattgggcaagttactgaaccttctaggaccctctgcaaatggggatagaatataacagtagctaccttagagaagtatatgtgaggattcagtgagacaacatgcttcacccagtgcttagggaacagtaaatgtacaatgaatgcctttgtattgttaacagtgcaattattatttttattctggaagagtaccctttagcaaaggtaaagcaaagagacacatgagttgtgtgaagacaaattcatcttccagcaaaccacgcgtcattttcatgtccccatgtgttcgaatgccctcggcaccaatctatcacaaaggaaggtcacccatatttatctgtatgtgcagacaggagaccattccggctgctcagcactgaactccggggtattgttttggtgaatcattcctggatgaaggaagatcagcagaacataatggtctttgactttgcagatcgtgagctgttgcttttgcagagccacagacattgatttatgaggcccaagccaaggctctggctgctccttgggggcatacagatctctgtgtgagtttggtgttttctgatggccaagacatggtgttcatgagtagggggtagagggtgagaactcttgaaattcctggagggcactaattccaaggccccatcatgtcttgttggcatcaattcatgggtgttttgccctctggtggtttcctgggcacctttgagaatggctgaccatgaggaatggcatgtcaggctcccacagaagcaggccctgagatgaagattgaggcctgcctgtggtttgcttgagaggtacagggacagataccaggtaaggtgaggtacagaaaaggaagtcagacaacttgaggtgcattattattattattattattattattatcactattgagacggagttttgctcttgttgcccaggctggagtgcaatagtatgatctcagctcactgcaacctgtgcctcctgcattcaagcaattctcctgcctcagcctcccgagtagctgggattacagacacctgccaccacgcccagctaatttttgtatttttagtagagatggggtttcaccacattggccaggctggtcttgaactcctgacctcaggttatccgcccaccttggcctcccaaatgctgggattacaggtgtgagtcactgcacctggcccttgaggtgcattattaaagcagctcccagagtgggtaactgcagctttatcctttttggggagctcaaggaaatgacattaaacacatacgttagagttatctcagctaaggggcaggtagctagaatatctactcccccaagtctgataatgagacataggttcaaagctgtccccaaggatggggggctttaatttccaggcacttgccgccagctgtgcgcaagggaaacctgggatccatcagctccaatatcctgtcctcttgaggcctcggccttccaacaacatcaggagctggctgtaggttgtgttcgctctcctggcttttagccaccccaaatggcagccagggcagctgggagaatggcagccccccaccctggacgggtggggcagctttgagaaagataggtggtgagaggtcacagaaggaaagaattagctcccaaactgcatgactgacaaagatgaatgtggcatttacctaaaggtgcacgttctgtgtcctgaaagatgcacattgcttaggcatgtctgatccttcttcttgaggctgttgaagacaagcagagattagcagttacgtcctcattgtctaacttctgaaagcccagccactttccctccctctctttcctgtcttagtccctttaatttttttttccatccagtatgcttagcaagcatctactctgtgctggcgctattctaagctctgaatgtgcaacactggacctggcaggtgctgcttgttccctcctggtattcatagctgaggagggaggatagcatccaataaatcagaaagaaaattgcggcaagtgctacaacatagttgtatgggaggctcatctcgggaggggccaaacctagtcttgtagtgagataggaggccgctctgaagagatgatgtagggagtttttgtcttttatttttcctccaggatccacctgagttccttttcaagacacagttcctttaatttttaaacacatccagccattccagacataagaaaaagccagccgatcaagtcgcctttgggactaatggctatcctgagagctcagctttgcttggaagttgctattttccaaaacagcttgagctaaataaagatggctgggatagttgatagttgatatttgacacctagctcagccgatggtgttcaggttgttgctatggcctggtagtaaagtcccttttctggttactttttacttgttgcagtaactgtgatgtggcttttcaacccattgactgttaatttttttttgctgatattttcagactttcatgctgtaggttcctccattctcaactgccccaaccaatcctatgtgtttctggaatatcaggcatgtggctatttcttttttttttttttttccttaggtagatatattttttaaaaaataaataaagcaattctgttcttttcaagtgaaagaaaatgcagtcactctccagtgccaccatccagagataaccacagttgacattttagtgagtgcagttctggggttctctcctggcatctctacacagagagatgcaggtgcacagttttacagaatgggagctctatgtgcttttccgtaaatctctctcttcactcctcagggtcctatggacatttttgtaaatcaataaacatcaagcaacatcattgtttcaaacagctagagtctggatctaccatcgtctccttaaccaatttcctatcgatttaagttgttttcacttttctacacttccatcaattctgcagaagagagctcatctcttcccatgtttgtgacaatttctataggatatatttacatgagctggattaatgggatggcggatatgccctgttatgttttgatccctattcaggtgatgcttctaatcagaggattttagtctgtatcttggctaagcttgttcatgcagcaggatacaatagtctttcttttcacacacaaacatactgatggatatttttgtttgtttctccagatgacactcagtatctacaagtttttgtggtcatttcactagctgttttgtagatagtggatggccttgctatggaatccttgctggatattgtggtggaggcagaggaatgcagtggttgagactggcccctttccttaggtcatcactggaattttagtgaagaagtgctgcccagggatggcatcattaacatgctgcagagcccttgagcttggaggagacagcacttgagttatggtacaattcactgtaaatgtgttttatggtcgcctaaaatgtgtttaggtgaccataaaacacgttttatgaaagagttgcataatccaatcagagaccatttcccaaaaggaaaattcacagctaaatggaatgaaaagtattatctgaacttcactagctattgactccacctagtcgttcaagaggaaagcgaatgcttatacattgttagtggaaatgtaaacaaatacaactgtatggaaaggaggatggatagttctcaaaaaacttagaatagaactaccatttaatccagcaatcctgctactactgggcgtctacacaaaggaaaagaagccactgtatcaaaaaaacacctgcactcatggttatcactacgtatattcatcaccacaccatacatacatacacacacacaatggaatactattcagccatataaaagtataaaatcagccgggtgcggtggctcacgcctataatcccagcacttagggagggtgaggcaggtggatcacgaggtcaggagatcgagaccatcctggctaacacggtgaaaccccgtctctactaaaaatacaaaaaattagccaggtgctgtggcaggcacctgtagtcccagctactcaagatgctgaggtgggagaatggcatgaacccgggaggcggagtgtacagtgaaccgagatcgtgacactgcactccagcctgggcgatagagcgagactccgtctcaaaaaaataaataaataaataaagtataaaatcatggctttggcaacaatgtggatgccattatctttggtgaaataactcagaaagtcaaatactgcatgctctcacttataagtcagagctaaatcatgtgtacacatggacatagagtgtggaataatagactttggagactcagaagggtggaagcgtggcaagggtgtaacgtgtgagaaattgcttaatgagtacaatatatgttactcaggtgatagttacactaaaagccaagacgtcagcactctgccacatgtccgtgtaacgaaactgcacttgtactgttaaatctatacaaataaaaaagaaactgaatctttgccaagttgctcctaactatgtctgaaggtcctctggtgatatctcacaccggctcagaaccaagacagtcggctcccttgtcatagccattgggatttccctcctccatatcccaggcccccaccctgatgggcaccattgcacatgtcaggcccgccctgatgggcaccattgcacatgttaggacccttggctgctggctcatgggagctggataccaaagcatctgctgggacaggagagaatgcctgaacccctttattctggtagaagagtatctaaccaaccaacagaactgtatgtttcttctttaatgtgaataactgtgaaaacaactcttttcatttttatttatagctctctctccccctaaattcacacatgcatctctggggctggagatcagctcaagagatggacaccccattgtttcctgaaacactctcctctctaaccatgaagtcttattcctggactagcctatgtatctgcctctcctctgcccatcacccatgctcatatcattcacattagacctttgtattctgggtgaactggggagatgtggcccttgggttcactttgattacttccttgtaaaaataaacgcttaatagccctgcccactaattttttggatatgatattttaggcccaagccgggagtcatccttccatcactctatatttggaagagggaaggatttgtggcatcaaatatttaaaaataaaagtaaaaatattaaaattaattgagtaacttaattaaaataatagtttaaagtggcagcagggcaaaggagcatttgtagcttcagaaatgtagtgatcattctacagtcttttgaaaagataaacctgacaggaatttctagcgaaaatgaaaattggtgacggttgagcagctgcaaagcaaaagtgaaaaagtccttgagttgtcctagcacagaacgtgctcaccagcgccgttggatcctatccctgataccaaaggatccactgtgaatagcccagcaatttttagcactgcagctgagtaaaacagagtggcagatccaaatgtcattaaacatttataatttcggggaaacccttatttcaaatcaattcttcataaccatttcctcagtaaattcattcaacaagtatttatcgggcagtttctatgagtcagataatattataggggctggggatatagcagtgaccaagaccatttagaactctattcttaagacattgccaccttcctgggaggagaaaggtgccaacagaaatggataagccagataatttaagtttcggataaaataaaacaaggtacattgttttattgacataaggtcaagaaaagtcctctctaaagaggtgatgttgaagctgagcccagtgaaataaaggagcctaccaagtaaaggcatggagaaaggatgttccagacgcaggggccaggaagtgcagagacctgaggcaggaatgacctgagggacggtagtaccaggtgagacagggagatgggcaagggcaagggcaagatcgttctgagcatgagtcaacaaactatgggccatgggccaaatgtgtctctctgcctgttgttttttaaataaagttttattagaatacacatgtgccccttcattcatgtattgactatggctgctttcgcaccatattggtagaattgggtagcggggacacagactgtatattccacagaggcaaaagtatgtaatacctgatcctctgcaaataaaaagtttgcagacccctggcttagaactccatacattttgattacattttaaacttagtaggaagcccttgggtggttttaagcgaggaaatagatatgattttactgctgaaaaatgacttgtgctattctgtggagagagaaatagggaaacaaggcatttcaatgttctaggcatgagaaaaccatggcagctacggagatggagagaagagatcacataaaatttttacagcaagtgtgtgacaaatcggaaaattctaaatattgagtcattttatgatgccagcttattataactgatgccatctatgtggaattacaataatactgtaagccttaataggtttataaattttctgcaagtataaaccagaatctaccttcagttctctttctcagcaacacagttaagaccaggagaactgaatggttttctcttcatccttcaacttccaacatttagcagagtcccaggcacaaattatccacccaataaattccactggatgaacaaatggctccaaaggccagaaagcctgaatcccgataaactgttttttaattcaatttttaaataaatggttgtatttattgaaaatgtattcattctttcaacaaatacctttagagtacctgccgtataccaggtatgctgtttaatgaggatggggttggagggggtgaatgcatgaaacagaatggatgctgactctgtagagcttgcagacgaaagaggaagtcagtaaataaagcatcactgttacacaggggaacgtcagttttcaactgctacacaggggagcatctctctaggattaagggagggagatgatgcctgtcccagggtaacacagcagtggtaatcagctgtatatttttctagcactattatgtactggatactggtccaggttccacacctaccttttaaagcagtccttacaaacgtttgacaattgaggaaacagacactcagggaggttaggtgactccgccgtggtcacacagctggtgggtgatgaagctcagatcgaaactcagacctgtatgactctaattcttgtgctttttcatttcatccccatccacaacacccactgtcctttaactatttcacccgtgatgatgttgcaagtaattccaaagttgctaccttaaatgtaagagagcattttcttacacagatgagtgagtttatttattttcatgtgtgtgtgtgtgtgtgtgtgtgtgtgtgtgtgtgtgtgtgtgtgtgtgtgtagatgagaaagagaaagagaaaaccaccaaccttccttagtcattttatagtagcccagcttgccaggtaactccacgcagcccatccttactggtggtaacctcaaataaagccagattctccccctagcggtagtttgagagatgctcaacaactcgaagattcataaagcatgctgagccatccatcagtcaagacaggccacaaatgtcagaaaagattgataatcagcagggagcttgataaagcagcttttactgcagcacccttgctctaagactcccatcccttctgagaacgcagtctagagctgctgcttccatttatctatacaaatacctttgaatcacttcaccttaatatatatatacagtaagatttttttaaagccctgaataatttatgtatagaatcacctcccttcttaaccaaatggaagagattcagtatgctaagttcaatgggaagagggtatataaaatccctttcaagtatatgtcttataaaatataggtcatgaattgagtttttcagtatcaaagaaaaaaagtttaatagacttacagctttcttgctttaattatgggtgcattttttaaaaaccaagtatagtacccaagctattttattattcagaagactggctcttttcaaagaagtgtcaaaagtttggtttggggaattcttgtgttttctttcttgctccagttttccacttttctttagtgtgtcaccatctttatctcctatgatactagtttataaaaggcttctaacatggatgccttcctcttggaagtgggttggggttcgtgtttctatagtcaagctctgtatccttaaaaaaaggcctgcttttcagaatgatggaggacctcgctggcctgtttccctggcccatcacatccagactccagagctgctttgccatctgttcctctccttccttctcatttctgcaattttaccctctatctagctgaagaggttctatgcttgttggctcacactaaagtcataagccagggctagaggggatgacttgaatagtaacatgtgtgtacatatacgtgtgtatgtgtctgtacattcacatacacacacatgaaatcagcttcggtctgtgatgcaccattcaaaaatgtctgcgtagattttcactagctttggaaaccacgtttgatgtggtttaactggaaatattgacccacgcaactaaaactcaggtaacccaagagactactactgctggcagagtcgtgtttgctgatttcagacaccatggagcagtggtccaagtttgaatgattttgttcccaggagacactttgggttccacactggggaagaagagggtacaactggcatcgagcgggccaaggtcaaggactggtaaacatacgtcaatgcatagaacggcctccacagcaaagaatcatttgcctcaaaatgtcagtagtgccaatgtttctccctaaatggagaaaatgtggagttttagttataaagcccaaatgtaaagttggcaggagagatgctacaaattgtaggcattggttggtacctttttatagtgagccacaggaacccattcctctaagcaggatcaatggacatggagctcgttttaacagtgagcattttgcgagtgggagatgttgccaggccctctgctgagggcttcctgtgtgttatctcattgacttgccacagcaggctagaggcggatgctatgatcatctctatgtcccagtgaggaaactgaaacttcaagaagctagaaaacaaactgtccagcagagcagaagcattttcctcaaaatccattctgctgtcctttagtaacagacctcagtataccttagcagcaggtgtccgtatgaagactgtattgctcagcctccctggcagctaaatgtggtgatgtgaggaagtactgaccaacaagctagaagcaggggtctatgttagacttctaggatggattctgaaaggagccacctcacctaggaagagtaccctgtattctcctcctaccacctatttcttttgctgtctggagtagcgatatgatggctagaactcaagcagccaccttgctctgtgacacggcctcaagggtagaaaatatgtgctaggaaggcaggacaaaacacagaataagacctgattctgttgcctgcggaatgccatggcagccctggattgcttctctccagaattattttacataagagaattatgaacttctgtcttatgtaactcagtgttatgttgaattccctgtatttgtagccaaatctaataacagctgaaatatgcagcatcactcaaccagtaaaaattagagcccagactatatgacgttgagtcaagccacgctttttaaccactgtgctttgctgcttgagacataagcccacttacacctctgtatgcctttcatgcaccagttttcctatggtaatcagaaaattgagtctttattggaacaaaaatggtctttgtctcctctgttatcttagagttccttccagaaagcattctaaggcctctttgacattagacatttttattaggttaaaaaaaaccccactgccttatgatgggaactttcttagtgtagttattttgatttcctagtattactgtaatttcagatcacagtctagtactaataatctgaagagattccaataatgcacaccatgatggggctgccatttatgtcagtgtgctggcttcgtgtccacattccaggggccagagaggaaaactttaaagggctctagaaggttttcagagaatattaatttttttcttgccagtgaatcaagttgaagtgcatcatgagaaagtacctgtgagttcatcagggagatcaatgtattctgacaagggtacagcacaagggttgagatggctgattcccatctccaaaagatctggttttcagctatgtttccactgtgattatgagaccttaaacatgttatcttacctctctgggctttgagtaactcttttgatcatgaggctaataacaatgccccaaaaggatggctgtgaaggttctgtgagcaagtagatatcaggctttgagcaccatgaccaacaaaatgccacgtgggtcacaaatactggcagccagcaatggcttcttttcagtggtgctagttcaggagggtcttagtgtcgtcacccagcagcttgcaggagttggaaagactctagagacccatggagctgaattctagtcctggctccttctcttatcagctgtgttaatttgagcctctatttcctctactgaattggtgataatcttctgtggcagcactttgtacgagtttgaattgggcacattcgaaatgattcattatagaaatataaataaaattttatttgtgcacagaattagaaacagtgtgctctccaaattttaaatatttgtcacaaatttgcaatttcagagtggttgtcaggattctctctctcactctttctcagttttaatgagatatcattcatataccatacaatttaccaattcatccatacaaaatttgtcattcggtggtttttaatatattcacagaattgtgcgatcattgccacagtcagttttgaacatttctattatcccagaatggaaccctgtagccattagacgtcgttccttatagtcttaggacaccacacatatactttgtgtttctataaatttgccttgctgggcatttcatagagagagagtacatagtacgtgatcctttctgcctggtttattttacttagcgtgttgttcaggtttcatccatgttctgtgtagcaggtaacagtacctccttcagttctattgccaaagatagggcttccttttaaaataaatttgctctcgccataggaaatatcgctttagcttgtgcagatgaatatgcaccattcttcgtcaagattagtcttgagttatgcaaattctgaattatctgagatattcgacaatgtaccacgtacggaaaatacatctgtgttctgtgtaccttgcagttttgttatgagaattaaatgagataatacacgtagcagcagggctcaatatatgggagggggttcctcaagaaatagagccttctacaattttagttggtttgattgtttcatggtagatctattttttatctgctttttctataatctcaacctttttttttttggatttgggcatacacatgcaggcttattgtatggatatattgtgtgatgctgacgctttgagtatgattgaatctgtcacccaggtagcaccatagtacctaacagttaatttttcaaccctttctcaccagcaccctccgctagtccccagcgtctgttattgccatttttatgtctaagagttccttatgtttagctcccacttataagtgagaatgtgctgtttttggtcttctgttcctgcattaattcaataggataaaggcttccagctgtatccatgttgctacaaaggatatgagttcattcttttctatggctgcatagtattctgtggtgtatgtgtacattttctttatccagttcaccattcatgagtacctaggttgattccatgtctttgctatttgaatagtgctgcaacaaacatatgagtgcatgtgtctttttggtagaacaatttattttattttggatatatacccaggaatgagattgcttgttttaagtgctttgagaaattgccaaactgctttccacagtgcctgaagtaatttacattcccacgaacagtatataagctttcccttttctccacagcctcatcagcatctgttgctttttgactttttaaaatagccattccaactggtgtgacatggtgtctcattgtggtttcagtttgcgtttccctgatgattagtgatcacaatttttcatatgttttttggatacttgtttgtcttcttctgagaagtgtctgttcatgcctttgcccacattttaatagggttatttgtttttcgcttgttgaattatttaagttccttatagattccagatgctggacttccatcagatgcataatttgtgaatattttctcccattcggtttgttgtccatttactctgttgatagtttcctttgctgtgcagatctttagtttaattaaatcccacttgtcaatttttgttttccttgtgattgcttttgagaacttagccataaattatttcccaaggccaatgtccagaatggcgtttcctaggttttcttccaggattcttacagtttgaggttttaaatttgaatatttaatgcatcttgagttaatttttgtatatgatgaaatgtatgggtcatttcattcttctgaatatggctatccaggtatccagaaccatttattgaacagagagtccttttcccattgcttatttgtatcggctttgtggaagagcagatgcctataggtgtgcagctttacttctcagttctttattctgtctcattagtctatgtgtctatttatgtaccgtaccatgctgttttagttaccgtatgcttacagtagagtttaaagtcaggtaatgtgatgcctctggctttgttcattttgcttaggattgctttggctatttggggtattttttggttgtatatgaattttaatagtttttctaattctatcaaaaatgatcttggtagtttgataggaattgcattgaattcatagggagctttgggcagtatctcatctgtttttgtgtttatctcactttaaggaatctccatctatgaaaattccaactgattaaataaaaaattagtcataagtcccctctaacagacctgctcatcaagtgtctccaagatgctgtttaaaaaaatctggtttcttccaaagtgtcaggctttcaggagcccaccagtgattcaagttacataccccttcataaatttccacgcacatccacatattcatgaggcaatctgagacctttacctttgtcagcctgagtacatttctattatggcaatgtcacagccgcgtgtatgagctgtaatgaaagacagcttttgaaaactcctattctaaggtctttcctgacctatttcagcaaaatgtgtaagtgaaagacatttagacaccttttgtctttatctctttttgccctaggcaattaggtgccacaacaaatgacatttttgctccttcagcaagccatcatggctcacctcataggtgggagacaccaggatgaacactttcaaattctttatcccattccatccccccagtgagattgggtattactgtctccatgtttcatgtgaggacacagaagctcagaaaggtcaacacccataatcagagggggaaccatgtaagtctgcctttgcctgacctcaaataccatcttccttcaaggatactgcatttcctctgtctcattgtgggttaattacttcttagtatgcctgcttttcctctatgataaggcacttttatacttattcggcggtctctaacataagcattcagtcctgctccccagccaaggctgtgcatataaataggaaatgttgattttattgcttatgggagatgcaacaggcaagcatcaaaaactgtggtggggtttcagctggaagtgtgcacgttaagaagctgctctaagtcatccctgtccatggggtttttccttacagcatgagacagtccggctatgccttgtcctaattgcaactcaaaggataaggtcaaactacattttaaaaagggcaaacatcaccaggaggaaattttctagagttagaaaaactgtaaccaggaatctagagatgacatttatcttttaaagtatcaatcagagatgcattctgtttcaggcaacaaaatagcaatcagcacagcttaaacatcacaggttgattttcctcgtatttctagaagctgggagatgggtggctgcttcttgtgcttcattgacttgatagttggcatctctgtgagtctttggactttcctttgtggctccaagaaaaagaaaacatataaagcagtatttaaatatgtgtaagcacatatgtgagtatgcatgtgtgcaagtatgtgtgtatacatgcattgtgggctagggaggaaggaatttggaatggatttggggttagcctgtgagtggtcctcacactgtacccaaaagttaagagaccactaaatgaagaagaaaccagcatttcccaagcttttattatgaatttgagaattagttggtggtgagaggcatcactgaaatggtcaattggttaaataagagaaggaatcaaagtgaaactggcttctttactggcagaattttgagagacttcaagatgtgaataggcatgtcagtttccaagatgatgtcacaccagagaatctgttatgagcaggatgttccgtcagcctggcacatgggaggtggcagatcctttggaacggcagctctcagatcctgagctgctaggtatcatgggatgctgagtgggcgtgctcctcctccatagaggagttattaaagccacagagttaaagtaaaatggcccgagagcaagacaatgaatatcagagagggtcacaggacatcaagtggacttgtgaccttgggagtgtaagcacctacagtggacagaggggagtttgtgagcaattttgggataggagccatgacattaatacttcttgaatctcattccctccacactcacccctccaatttagctagctttctctgaaaagccgatactcaaagaataaaatgtttaccgaatgaattaacatgttatataaatgtcaacgcaagaattttggagggtcatttatttcactgcttctcatggggaccaagcatccatctaggttcttggtaggaaattgactatctgggatccttaagatagacataataagtccacatacaaaatggcagacagattttctgcctgtggatctacccagaactgttggtagctgtgttttgggtttccaggtagtctctccctcactttcctgttgactagtaagtgcctggctttgatgtaactgtactgtgcaagatacagagccatgattttcatacatatcacctcatttcagccttgcattatcccgagaaatagataaaggagttctcatttacagataaggacctgaacctagtacacaggaaacttacctaagtctcacaacttcccttcacatcttctctaagaccatgtgaacctgtctatataaaatagagctcaagatggaagaggtgactttaaactcataggtttttaccattggcccagaggaaaaatggagctggaactccattacttggttagtctagggaccagtgaaagtagagtgataatttgggacttttatgaatgtttcttttatagatgtttgtatcagccactgttctctagggaaacagaaacaatgggaagagagtgtgggttggaggaggcagacagaaggaagaagagagagagagattcattgtaagaaattggttcttccaaacaccacatgttctccctcataagtgggagttgaacaatgagaacacatggacacagggaggggaacatcacacactggggctttcaaggggtaggtaagcggcaaaaggagggagagaattaggacaaatacctaaggcatgcggggcttaaaacccaggtgttgggttgataggtgcagcaaaccaccatggcacaggtgtacctatgtaataaacctacacgttctgcacatgtatcccagaacttaaagtaaaatttaaaaaaggatattggttattatgattatggaggctgacatctgcagtcagtagctggagagccaggaaagctgatgtgtggctccagtctgagtctgaagtcctgagaaccagagagctgatggtatcatttccagtctaaacgccagcaggaagggccaatgtattgtttaagtccgaaggctggagtggactgatgttgtagttcaagacaggcctctgactcagctttttggttctgttcagacccgtaagtgagtagatgaggcccaccacattaggaagggtcatttccttttctcagtctaataattcaaatggtaatctcttccagacatgcccttacatccagaataagagttgcccaagtacctggttaccccatggtcagctgagttgactcataaaattaatcatccaactgttgtaggccaaatgttggccccatgatctccacctcctggcattactcctgcagttatgtggcctcacatggcaaaggagactttcttagtgtaattaaggttattaatcagctgaccttaaaacaaggaggttacccgggattatccaggtggacccaggtaatcacatgggccctttaaagcagaagaggaaggcaagagagtgaagaagagagatgcagcagcagagaagagttagagaaatgaggccaaagttagttcagagggttgccaattctgagatcctgaggattcaacctgctgctggcttgcagatggaattgggctgcatgggaagtgtgagaaataaatccattctgccagcaccccaaatgatgctggaaaaggatttttccccccagggactccaataaggaacactgccctgctgaaactgagattttggccttatgagcccctaagcaggaaacctactgtgaaccccacggaggtcatacttctcacccacagatactgttgttgttttaagccacttaatttatgataattttttacaatagcaatagaaaactaatacagaatgtggttacattatcttacataccatttaagagtaaagctgcttttcacaacaaaataacagggatttttttaaaaaagcacacacattcataaactgttgaacagctatcaaaagttcgttttcaaatgaattaccaacttacaattttcaagtattcccaataccaacatcattcttaaattaaaacagcaacggaagcaatctcagggacatgtttagcaacacttcctagtgaagctcccagaattatgaatacttttggtatgcgtgcgatgccactcattaccacgaaccgtcttttgaggaggttgcgctgactgcattaaggagctttacgtgcgagtccccagcccactcagctttcagaagtcacatcgctgcttgccacaattcacctcgctttcccagagtagacatctttcataagatgctgggatttgaagtggaaatcacactgacagaacgacatcatccctgcgattgggataagctaccatcattaaggaagtcacagttgctggtttaaggcttgtacaagcttttcgatattctccagatagtctcctgacacctacacctagaacacatgtgttggaagtaatcctttatgataggtcccttaatgtacttgttttggaatatgaccttctcctgacctgtcttcattgcagaattgctggaaagtctgaaatggggagcacagaaggtcatggtgtggtggttgacacttaggaactctcaaaaaagtgtataaattgccttgatttatcacatactgtgcgtaagttatgctgttctcattcagccaacagtatgtttaatacccaaagccctctttttttttctccttctttgtttttggcatataacagcttattgcagtataattcatagactgtatgattcacccatttaaagtatataattcaatgttttttggtctatttataaagttacacaatcatcgccacaatcaattttagaacatttaatgactcccaaaatgaaattctgggctcattaacgatcatttctcatttcctcgaaaactctttggtactagacaaccaatgatccactttctacctccatggatttgcccattctggacatttcatataaatgcagtcatgcaatatgtggccttttgtgtgtcttctttcactcagcatcatgttttcaggttttattcatgttgtaacatttatcagcacttcatttcattttattgattattaatattgtatgggattatattttattttaagtttttacgttatattttatgacatttatccatttaaaagtccatggacatcgggttgttactactttttggctactatgaataatgctgctctgaacatttttgtgtaagtttcctgtggatatatgttttcatctttttcttaagtatatatctgggaatggaattgctgagttataaagtgactctgtgttaacctttggagaaactggcagactgtgtttcaaagcagctgttccattttacatttccatcagcagtgtatgagggttctaatttctccactttttaccaacacattattattggtcttttattatagcctccttgctaggtgtaaaggagtatctcattgtggttttgatctgatttcctttttcaagattgctttgcctagtctgggttctttgtatttccatataaattttgaaatcaacgtttcaatttctgtgaaaaaagagaaaggcagctggaattttgaaaggcactgttttgaatcaatctgtagatcaactggaagagtattgtcagcttaacaatattgagtcttcccatccatgaatatagaatgcctttccatttatttttgttaatttccttcaacaatgttttatagttttcaatagacaagtcttgcatttattctgttaaatttattcctaagtatatttgatgatattgtaaattgaattattttcttaatttcttatgtggattattcattgttattatatttaatcaattgattcttgtatactgatcttgtgtcctttaaacttgctgggagctctcttttaacatagacattattatgcttattttatgtcttcatttatttgctcaaatctcgtagtagagctactggagcccaacattcatattctgtttgttatacactcataattatacaagtacatgtgcacaagtcaaatattaaacagatacatactgaggtagcattgttccaaatcctcatctatttgagcttacctttctaacgtgtgaactaattatggaaagaatttggttgcttgctgtagctcatgacttaggacgcattttcccctcttcaactgtcttttatttgagccatgattgaattattcaccatgcctagttgttttccttttcctaaacatttaaaaattaactcattttcttttttttctttttttatttcaataggttttttgggaacaggtggtgtttggttacatgagtaagttctttagccgtgatttctgagattttggtgtacccatcacccgagcagtgtccactgtacccaatgtgtagtctcgtatccgttgccatgcccaaccctttccccaagtccccacagtccaatacattattcttatgcctttgcatccttatagcttagctcctacaggtgagtgagaatatatgacattcgattttccattcctgagttacttcacttagaataacagtctgcaattccatccaagtttctgtgaataccattatttcattcttttttatggctgagtagtagtattccatgttatatatatatatatatatatatatatatatatatatatatatatatatatatactaggtttttttaatctgttcattgattgatgggcacttggcctggttccatgttcttgcaattgcaaattgtgctgctataaacatgcatgtgcaagtatctttttcgtataatgacttcttttcctcttagtagatacctagtagcaggattgctggatcaaacagtaggtctacttttagttctttaaggaatctccacactgtttttcacagtggttgtacttgtttacattcccaccaagaatggtcatgatcaaaaaatgaaaaaataatagatgcggggaaaagggaacactttttacactgttggtgggaaaattagctcattttctagtagcagtatatctctccaacaaacaagtcacctgtttttttttcctgaacacaccatctctcatcattcttgatgctaaaatataagcatgtaggtccaaacctgtctctcctcctttcagagtgaccagagagacccttctagtgttttgttttgtttttttgagctggggtctcctgtgttgccagtctagagtacagtagtgcagtcatggctcactgcagcatctagctccaaggctcgggtcatcctcccacctcagcctccccagcagctaggactacaggtgtgcaccaccaggccctgccaatttttttaaatttatttttcgtacagatggaatctcactgtgttgccgaggttggtctcacatccctggcctcaagtgatcctaccacctcagcctcacatagtgttgggattacaggcatgagccaccatgactgtcttcttctagtcttgatgcctctcctctccatctgtagaccccactcctcctaggtcacttcctgtgaccccacaccaacatcctttctctagaaacggccattcccaaactgtgagcctcgtgtttgtattcatgacacatatgtagcatccactgtgaagtcaaaattaaggtgaatggtaaactcaaccacctggcttcatgttgaccttgtccctagactcccattccctgcagctggtcttgctctctactttgaaaacacagttgatgccatctgaaacgatctcctccacttggatctctctgcccgtatttacctgtatctccaatatctcctgctactcaagtatcttctttttattaaaactttcatatcgttggctaggcgcggtggctcacgcctgtaatcccagcactttggaagtctgaggcggacggatcgtgaagtcaggagattgagaccatcctggctaacatggtgaaaccccatctctactaaaaaatagaaaaaattagccgggtgcggtggcgggcggctatagtcgcagctactcgggaggctgaggcaggagaatggtgtgaacccgggaggtggagcttgcagtgagccaaggctgcgccactgcactccagcctgggtaacacagcgagactccatttcaaaaaaaaaaaaaaaaacttccatattttcagttctatcttctttttattcttcctttacctgtacctttattgatttattttaacttttgttttaggttcaggggtacatgtgcaggtttgttatacagggaaattgtgtgtcacaggggtttggtgtacagattatttcatcacccaggtaataagcatggtaccctataggtagtttttttgttctcaccctcttcccaccctccacccttaagtaggtaggccctggtgactgttgatcccttcttcgtgttcttgtgtactcagtgtttagctcccacttataaatgagaacatgtggcaattggttttccatttctttgttactttgcttaggataatggtctccatttccatccatgtcactgcaaaggacatgatcttgttcttttgtatagctgtgtagtattccacattatatatgtaccatatttctttaatccagtctactgttgatgggcatttaggttgaatccctgtctttactactgtgaatagtgctgcagtgaaaaaatgctcaacatcactaatcattagagaaatgcaaataaaatccacaataagataccatctcacaccagtcagaatggctattactaaaaagtcaaaacgaaacaggtgctggcaaggttgcagaaaaaaagggaacatttttacactgctagtgggaatgtaagttagttcagacgctgtggaaagcagtttggtgatttctcagtgaacttaaaactaccattcaacctagcagtctcattgttagatatatacccaaataaatataaatcattctgccataaagatgcctgtacttttaattctattttctgttgactgccccatggcctttctttttaaatcattaccctctccttcctgcatcttcagtcacattctccatcatttcttttgcattagtggagaaacatatccaggtctcccaatcctaatatgagagaatccactatacccctgcctttttgttcttgcttactgcccattataagcccttttcctctttcttggcatacttatactttctgaaaatgcaatgtttattatgtcagccatgtatacatctgctgttgtgaaagataattttaggtggcatagaggtgatcttttataattttaatagctatttattttgatgtacaactaagcaatacctggtacgtttccataatttaaatcatatcattgcttagaagtaagttaaatttcaaaaatcaatttaaagtatattgaaagtagattaatagtggtactgtcaatacttacatatgaatcactgaaatactggaaggctttgcatgtaagaaaagcagaactttaaagacaaacggaactcagagtggatagtacccctgaatggacagtgcttcacgagtcttttctggatgaccctaagaaagttagttgtctacattgcagaaaggctatgaagattagagcaatgtatttaaaggaacaagaacattgtccagaaaaaaaataggtgtttaataaatggtaactaatcatcccccggaccgtatatacagatatatagggatacctttggggaaagtagaatggcccaatatgtaggttattcagttccacgtaagtgggtgttcacgagatgcttcctgatttgaaacatcaccatcatcaacaataacagcattgatgagaggtcatcatgggccaccactgtactacgcctttcagatgtacacctcactcattcccagtttgcaacagctttgtatgggaggttctgtaacatccccactttataggtgagaacactgagtctcagggaggtgaaatattttacacaagattgctcaactagtgacaggtgaagcagagattcaaattccagaagtctgatttcaaagttgtctctcttaaccactgtgttgtatctcaaatcatgacagttctaacttcatgtgtcatggtacttggcataaggacgtttttctccccattcttccccaaattcagtgcaaaaaatatatatgctgagtttttcatgggccaggtctactctattcttagagaaagggtcgggtgcggtggctcatgcctgttatcctagcactttgggaagctgaggcaggtggaccacgaggtcaagagattgagaccatcctggccaacatggtgaaaccccatctctactaaaaatataaaaatttactgggtgtggtggcatgcaactgtagtcccagctactcgggaggctgaagcaggagaatggcttgaatccgggaggcagaggttgcagtgagccgaggtggtgccactgcactccagcctggtgacagagcgagactcggtctaaaaaaaaaaaaaaaaaaaaaaaagacaatgacagagagcgacaactcatctctgcatctctgctttctgtggggaaacttgcaagtaaaggagactgacaagtgatggcgttaaactgtgctaagttgacaaaacacagaatcctcactgcctatgaatatggatctagggaagccagcaatggacctttggcagagtcaagtgaaatctttataggagatgaactgaaatagtttagaaagaatgcattaagatagttttacctaaatagtttatcgtcatatcaataaaattgatcatctctatcaccagttttaaagttggctttgacaacttttccaaagccagagtttgggcatatttgggtatttccataatattgagcaaatgtttaaactatattgaaaacgtttgccgtgcataacagcatcccaataggaagcagacggcatgctcaaactaggacagttgtaggaggacctatttttaaaagggcctagttacaaaggggaattgcaaaggataggagcataaccttgggcagtaagaactgagtaggaacagtgctccacagagagtgcaaagtaagctgatgggttgaagctaaggagcagggaaaagatctagaaggctcccaggcagaaagtgattggtaagctgagtcttgaaggaatcccttctggatagcatgagaagcttgttccggaagaaggaacctatgtacgaagacctgaaagagtaaggcatgatctgagaatacaggtagagggggtgtgacttgggcataggctatggggatggcagggagtagaaagggctggaaaggccaccatgatacaggtgttggagagaggcaggcatcatgcaaagtgtatgtgttaagactattaggaacaaaatatttgtggattaaagatataacacagtggttaagagaggcagctttgaaaccagacttcttggatttgaatctccgctttacctttcactagttgagggatcttcgataaaatacttcacctccttgagactcagtgttctaacctatccctagacctgaggaatgaaggaagagtcactgatctggaaggcgtgagtcccatagagagcctcgtgggaggaacagagaccaccagcatgggatacatccaaccgcaggcaacccgaaagggaaggatccaggggaatgagcatgctgaccttactcaaccaccaccttctgatctccaaacgcaacaggaagtcgaaggtctttctctattcaggccagcctctaaggacagaggggaggcagtggagggtactaaggcgtgctaaagggtcacactaatgatgctccgcaaagagtgcaaactttcttatatgttcttgctgctgttccataaagcaaagactggatccacataacctgatggagcaaagtcttagtccaaccccttagcctgcaaactctggaattttagaaaagtcaatagtgtgccccagacatatttcaatatacctccattttactccaggtaaaaggtttcttgcatccatttaactattgtaaatgaataaccatgtgaccctcaagaagattccaagccaaattccattggtttctaaggtcttaggtttgcttgcttttggcaaagagtgtacttatcttttcatgcatgcctttaaagagaccatattttttctctgataaagtcaattatcagtgtatgtgctgctctgttcacagttttgactaaatagtgcaacatctacgtagaaaacataccccaaacttgagttttcctgggttgtgcattgtacattgtcaaagcgtaaagaacatctgagttggaactcgtacccacttcaggatatgagaagatgcaggtcagtgatttgtttcgaggcggaagaagcttaaagaaagtaccttgcgctgtgtgttcctccattagcatttgttattatgaaagcattagactatctctggatgttttccacacacctgagagtgtgaaagaatgacaggtacctcattaaagatgcataatatctagtctcctgttctcacacagactccaaccactggtatgaatatactgcttccatatgagcctgctgcaagccagccagatcctattcagaatatctcctttctaccacatccaaatgtgggcagcctatatatacagatttgaagtgcaaagggtttgagtcaactttttgataaccgtggggattttccatctcaagaaattccgaaaatgatgtaatgatataatgtagcagaattttaatttagtaggtaggattaagagctgacaaatttcctctctttaagtttctttaattctgtctgtgcaagtcagagcattcggtatattcccaccctcccagctgatatgctaaaattggtttcactgtactactctcaggcatgcaatgagctaggcaaagctgtttagttacttgcgatctgtttacattacatagaaggttggttaattagaaataatcatgtttcttaattaaggaacaaattgatttttaaagaagtgctgaggcccccttgggccacagcagataagggactgagctcatggtttgtggttgtctgtgtgattctctttaaggagggtctgaagtgtacagtgacacagctatcagtggctatggaatcaaatatttgtagattaaaaattgtactcattctgctgacatcttatgagtatctgttgtgtgcagagaaatatgttggaggactctgggaacttgaagataagtaagacaaaatcagatctttaatggagctgagggtggcatggtaaaaacaggcttgtatgttgtatatttagcaaactgtgttaagtcctagaagagagatgggtaaatatcccaggaaaacactgagagcaaagtaagctgatggggtgaggctagggagaaggcaaaagatctagaaggctcccaggcagaaagtgattggtaatctgagtcttgagggaaccccttctggatagcatgagaagcttgttgcaggaagaatgaacctgtatacaaagacctgaaagagtaaggcttgatctgggaatacaggtagaggagatgtgacttgagggtaggctatggggatggcagggagtagaaagggctggaaaggccatgatacaggtgttggagagaggcagacgtcatgcagagtgtatgcattaggactattagggtgagtttaagcagggaaaaaaaattgcatcagctcatttatttaaaggaccaagaggagctttagggatagcagtatctaggtgttccaactgtattgtgaagaatctttcttacttattccttggctctgcttttctctgggatagctttccccaggtgatagcaaacaaaaatggccacctggcattttccctactattttagcaaatgaagctgcccctcgcccttcataaaagtattgttcccatgtaactccctttaaagttttaggtatgcctctgttggcccagtttaagtcatgtgcccatccctgaattagtctctgtatgcacagatgtggaagactcaaaggggcttgtgcctacacctagagccaggtatgggggaaaggtgataccagcccttcctcaacttcaaggactaagagtgaaagaatggtggtcgcttaagggaaaaggagaatgctgatatcaagagcaaggagaacagacgcaggacagaaataaatagatagctagtatgcaaagatgtcaaagtgacagctcttgatgagttttgagtaaaaacgacatggacacattttcattagaaaaaaattattctggctttggagaatgggtaggagagaggaacatctaactcggtgagatgctagcatgatgacaagggcttggtctcaggtggttgtggtagagatggtgagcatgagacatgcatactctagagagagttaggaggtacaaaagatggacttgggggtttctgatacattacaaagggccagaaatctttgagcatcttgtcccctccccttgattctaggtgaggaggggacattgatttgaccaatacaatatgtagaagtgacactctgccacttctttgatccaggccttaagaaatgggttgatttaatttactgtctcttgcaacgttcactctgatagaagccagcaccacataagaagtttggctacctggagactgccctgtgtggagatgctcaagctatatgaaagggccttgaaggatgacatactgtatgaacagagaggtcaaggaggagtgaagcactattcatgggaataaaggagctatatcagaattagactctccaaccctggctgacctcatgagaatctgagatgtaccacccagctgagtccttcctgaatccctaacccacaaaatcataaacacgataaaagtgacaaaatgtttagatgttttcattctacagcactaaataaccagaataagaactgaattaaacataaaaaggagggaggggtttatgttatcagccaatggcaagcaccactgaagtttttaacaaatataagacaaaaggttaaaccacacatctggcccacacccagcccccagttcctaaaaagcctggtccatctcttcctcttcttgccacatctcaaaggctatctctctatgtggatataaattatagatttaggttatagtttcccttcctcctggggtttcctctttgatgggactgtcaaactcttgggtgagctttattgtcagtcacagggtctgtcagttttcccatagtagtattatttcactcatcctttaatgtgcccattggtggtgacaaattttctaacatgcaaccacaggccataaatgtaaaaataaagcaaaagtcattgaattgaaaagcaggagacactttgcaaggctccaaccagtgagcttccatttcttctgcctgataatgactcccacacttatgccatttcttgagaactgtaaccagaaacccatgttttgggagtcaatagaatagatcagagcaaagacaaaggcaagagaagtgagattggtctttgttctggtgttatctggtagaaagaccataacacacagctaaccaataaggtactttgcaaaaattagaaaaaggtgtccccttcaagcagataagttctgagaaagtacccctctggaaagaagcagaccattgaggtcttggcttaatgagtagaagatgaatttgcatgtaaaacaaatatatcccttcttccagagagctgagcaagaggagggcaggctgctctcagtaccctttggacccgctaccatgcatggtggctttgaaaaagccaggcatttgcttcctaagagcacaccttgcagaagcagcatcaccatcatcactacgatttatccagcctttgctctatggtagatgctgtgcaagtgctttcggtctcatcctgaaacaactattgatatagatgccacatagatgacaaaacaacaactgagaatcttgatgccttgccctgaaacacacagactaggagtgggagagctgtaacttacacctgacctttctagctcacatgtggcctcctgttcagcggagagggacttcttggagaggtgccctgagaaaaacacatcccttgaccatgagtttttaacagtatcagctctcatcgggacattattatgttctagttgtctgcaacgataatatatgtgactgttattttgtctcatatctccaataaaggggtccccttcagttggattggccataccttcaggtgggatgcaactgtgagtctgtgtacatggcccagaagcaaatgcagcacagtggagtgattaagactctgatatgatccagttattgctggactggatctctgtttcttattatcatatttgcatgaccttaggcaagatacttgactgctctgagccttagtttcttcctctttaaattgggatgactgtagtttgttataaaaatgctgtagataattcccagacttgtaggtaacacatattattaaacagtagaactgtcgtgaccattaccagaaagattttacaaacaccctaaaatcatcataggattcagctagtgttcttagccttctaagctcacaccattgtctcatgctaaacttgtggtccaccagaaacttaagtgcatatttcttataattatttccaagataggtttctccagtttagaaattgtatatacacatgcatctatatatatatatatacacacacacacacacacacgtgtgtgtataacatatgcttatccttgatgtcatatttacccatgatttttattttaattagctttaccccatgggaagaatacaatgtcttttgtcttcaacctggtttgttggcaattattcttagcctttttaaaatattcaaaatctcataagcatgcattctgcatcttcaccaaagtaataacaactgtatatggtttagaagggcactgactacctctccctcaagtgtcaactaaaaaatattagatacgaagcttgagtcaagaactgtcctgggtgctgttgactcttctacgtccggtgtcttccatggcctatggtacaaagtcactccagaacattggatggatggatgggtggagagacggatgagtggatggatggatggtaaggttattgaatagaatagaattatatatttatgtttacctttgcctaaaaggcaaccatacagtgttttggtgaggttgatcaaccagttatatatttacctaagagtttgatcactcagcccacgttttcccatggtatgcacaacttgatcatgagaaggttttcacaggccttcctgaaatcatgatactatatatttgccaggctcctggtttatcagttacacaacaacagacttgaagaagaaaaccagctcacatctgtgcacaaggagacacacagttgttcattactgcattgtttgaaaaccactacgttgtaaattgcataaatgtgtatcaatgggtgaatggctaataaaaactttaaaaataaatataaaactgccattcaaaggaatgaacgaaatattatataaatatataacccaataatttctataaagattatatgtgtgtgtatatagatatatgtattatatatgtgtgtgtgtatatatatatatatatatagagagagagagagagagagagagagagactgtcccagaacaaggaagccaattttagggcatattccatataatacaatttttaaacaattaataaacatatacataaaatataccatattattctcagaaacaaatatatgcctaagatgattcaaaatggacattggtattcttgcgtgaggatgagagtggttgtcattggtaaaaaggttgaaagtcatagaacaggatatgacggatcaaagatcttaagctttatctgtaatattttatttcttttaataaaataaagacaaagcaaatgtgacaaagtgttaccagttggcaattccagatggtgggtgtgctgattttcatactattgttctttgtgcttttctgtgttttcttaaaattcccaaaatatgaaactgaagaaggaaggtaaccatcattggttgctgactgtcagcccattcattctatttttgctcccagctattttttatttgaagataaaagacgtgacagatacacgtgaaacctttctatctacctacctaatttaggattagacttagctgcatgtaaaagaaaaaaaaatctcaagagtgagacatttctttttatcacataaaagacattcagaggtctgtatagggcagtctggagacgtcatttgggacaaaattctaccattctcagcacgtagattctgccctccaggccacttcatggctcaaggtggctgattggagctccagccttcacctccatattctagaccaacagtaccctcccttcccaaaattacctctgcttacagctcatgggccagaattcatcacatggccatgtaactgcaagggggatagagaatatcatgtttcattagggcacattacccaaggtttttttttttttttcctttaattaaggaaaaagagaagagtgtatattaggaagtaactagcagccctgccacaaaaatgccctcatcctcactgccctccctcccttctcagaggaaggcactctcttagagttagtatataaccttcttgtctatgtttctataattaaataactatgttcctatccatttaaaatacatggttttattgatcttaaagttttaataaattctgcaattattgctttcttgttccaggaaacatgctaagtacttcatgcttattatttcattgtgtcctcaatagatggtaacaactacctatttaatagttgcttgcttttttcacattttagcaaatgtacctttttctaatttctaaagttgatgttccctccttgccatctggagtgagcacatctctttagcctccaccagttcctaactgcctgaaattttcccagaaatcgtggactccccctttccctgccccttcatgtcttcctggatttctgacatctggcttctcctgcctgtgcattaagagttccaaacctctctgacttaagccaacagtgactttcagtgttgtgcgttccctatccatgttcatgattttttagcaccgagatcgcatcagcaagaaccctcaaagccctgggatgcagttcttctggatctcaagtcttgaacacattaaatgataagctctttacagactttctcttcccaattattaagcagcaattacccttcacatcaccttctcccatatcacctctataattccaaccactctcacctaaaaaagctcacctaaacccaccacttgtctatctgagtcaaatcattccaaaccaaagctgcacatgcctgaaattagggattaaaaaaaaaaaagtaccaagaggataaacaccttccttcctttactagatccagggtatttttcaactgaatgcagccattgccaccctatatttggcttttagagacagactgaagtctaacaagttgctccttatacttgaattcacaagtataaaatcatatggatgacttgtgcaccttgctgtcattctgtgcagagctctgcctgtgcactccttccctcacttaccgagggcctagttcatcctccacctctgtggacacaggaacgacgaaaaagtctcccttatgacctaacggcttagagcatgggtcccataatccaatgtgaatgggcttccaccccaactctaccagctacttattgtgtggttgtgagtaagtcacctaccttctcagaacttctgtttcttcatctatagtagaaggatactaattcctccaccatagggatgatttgaggacagcactgactaatagccataaagtacttagcttgctgcctggcacataatgaagacaaaaatgaacattgaccaatactagcatcatctgcatctccaccatttccaccatcatccttaattggttgtgcaaataaatccacaagtacaatttaatcaggtaaattaatggaaatattttattctggggttattttaaatgtacagaaaagttgcacgaacagaacaaagaacttccataccccctcatgctgatccccagctattcacatttcactgcgtacactctatctccctatgtatgtatctatgtgatgtcccttcaaccctcagtgctccatcatatctgcctccccaagtacaccctcctgcataaccaccatgcaaacccacaagtcaagaaatgagcactgaaacaaaacccagtgcatcaatacattgatgcaatgtccaatctccacaccccgttcagggtttttctagccctcctacctttcccttcttaaaaataccttctgcaacagtgagaaatcttcattaacctcagatctgtccagctgtcctagtgatgtctctttttcatatctggcccaggattccatccagttacaccaatggttctcatctggagctgactttgcactcccctctgaccccacccatggtacatttggtaatgtctggagacatttgatcacacaagtgggaattggtattgacatctagggcttagacaccagagatgatgccagacaccgtgcagtgtgcaagacagaccccaagaattatccagtcaaaaatcttgaaagagctaaagtgcagaaaccccgagttacacattgcatttaattgtcacatctttgcagtctgccccagtttggagcatttcctcagtctttccctgactttcatcgtcccaacagtttggaagaatgcagccctacattctgcagtgtgatgctcaacgtggtccatctgatgtttcctcgggaccagtttcaggtcatacgttctggggagaaaaaccacagaaatgatgccatgttatcagtgttccacctgctggggcacacacaaccaaccctgcccaaggctcaggaatgttagcctctttcacctggtcatgtcaacatcctcaggtttccccccaaaaaagtcaccattttcccctttataatcaaatttgcagcaagatattccagatcatcgatcttgtgatatgctgctctcatgagacctcaactcacaagccttgactcacctgccagttcttagctgagcatctgccctgatggtgtggagtgatttcctttttccatggctccttgtacatttatggttggcattctactgcaaggaagactgtttcctcttctcccattagtatattcattcatttattttttatatcagaatggactcatgtggttttaattctttgggttgttttctgttgctgtctttcttttttaatgctgtgcttaaattgtgtcatatttggccagggggagcctggggcttttgataattcctcatttatttttactgcttactttcttatacaatgagatattctgaactcatgttgtaccttcctgcccaaccctggattgagtgacttcctcaaggaaccttggtttcttttcatggagggtggtctttagaaatcagtgtctgggtatttggtgaggttgtggctgctggagtgtcactgctgctaggtcctttcagcagacagagcaatgatacagacacacacatatacatacacatatacatccacacaaatatacgtacatatatatgggtgtacacatatatacacatgggtacatctatatgtactcatttatacatgcttgcacatatgtctacaactactgtatctctctgcattgttcatacattaaatttaaaacacaagttcaaactgatatctccaattccaatctaatatctaagggtttttctagccctcctacctttcgtgtttatcaataccttctgcaacagtgagaaacctattattattctcaatatatctactaattgatttgatgaaatcacatgatgtaaccagcctctcaaccatgccagccatctctgctgactgccacctctgcctgacttcccagagccccatatcccaggctaccagcaggcactggtccttcctttcttccctccaagtcccccaggccagtgaaagaaggaaatagactaccgaggcgaatttatggacagaacaatagggtcaagggttaagccaagaggcttattacaagaggtaatgcaaagaggctttctgcaggaatcaacaccttgagctgccccaagggcatagaagcatcagcaaggttaacaccctgtgggaacacgagcagaaggaatggttctgccaaaggcatggaggaagagagcctggtcactctggcacttgcatgtgggtcagcagcatgggatccgagggtatggagaggggagagtggtgaagaggaggctagacaggtgtgcagggccacatggcaaaaggcctcatgtggatcaatgtggactaatgatgaatctttcctgtctcactcttcaggcatgcgcttggcttttggattctttaagtactctcagataaatccacctgtcctttccaaagtcatttccatctattatatacaagtctcatgagttgtcgtgtgtaacatggtatgtccaacttctaggaaagtattttgtacatagtatatgctcagtaagtattttaaggcaccaatgtatatttttatctcaaataagctctcctggccctctttcaaacaaagatggttggcaaacagcagccagctcccagcacaggtggcccctactgtctctacatttgtatggaaaatgtaatgggtcatgaaattgcatgcattagcatgcggatgcttagacatatatattttttgcaaacatttcatcctataaaagtaagggaccaaagtataaaattctttagaggcatcagctggaggtagtagtcaatgagagagaatcattgtttccattaaatagtaccagtttttgtaaggcaagtaagatcttcatgttaattctaagaaactgtatgcctcattaggcagctaaggcatattatgatttggatgcagaataaccccagtgataaatgaatctcccagcagagtagcttccagattataatttctttctttgcaagattgctataggcaaggtggcctgatcacttttcagaggcccatcttaatagtcagagtaagctcagctatgctgtagtaacaagaaaatcccataatctcagtgtcttaataaattaaaataacttatttataacaaaatgtctaatgcaaatagggctccttcatcttgtagttactctagaacatggggtctctatggtcacctatggcatgggaaaagggattgaggtgacattcagctctttgctcagcccaagaatgaaactcatcacatctgttttcagtccagtgaccaatactagtcatgtggccccagcataactacaggagaggctggagaatatatgggaacctcctcacattcaccaaatggaatctttggtgaattctaaagattcccggcatgtcccactatctccttttggggctgagaaaatgaaagaaaaaactgacaggccaatgtactgactgctctctcacctgggtctgatcccatctgaagctactttgggtggttatcacaatgtagtttatcatagtgctgtggaatatgaactatgaccatagccagccctatattctagaaccagcatctccatttgtagctatgggtgcttggacaaacacttcaatgttctccatctcagtttcctcatctgaaaatagagtaaacaacagtaccaacctcatagggttgtgtggattaagtagttagaaacatgtcgctgttgaggaaacatgagctgctgttgtatttgaaatggtgctgaattcagaatcccatggaaatcttcactatgacaagaattaaccagcccagagccacatggagaaaagatgtgtggccacgatctcttgaccgaatccagcatcagaatccaccagacaaaaccagcatcaggacattggccacaaagggataggcgtcccaggatgctggaatgttgggggcagcgctattattagagacacctggtcactgacccagctttcttcccatggctcaagctgagacttgatagtaaaaactgccttaaatggaagcaactatatttttgatgtatgctcttctaggatgatactaaaagccatatataaaagaggtgttggttcaaaataagtgggatttttcagttccacctatacccggatagtattacccaccctacttgaggactctaggaggcaggtaagctacagtgaaatgtgctacccttgctagttgtggtcacttcatttaaggtaagaggttgtatcttcatttaacttgatgaggaattttccatcatacaattagttttgactgcaagtataagaaaatctaaccatggtggcttaaacagtttgggggatgtttgttggctgctggtattgattcaacatcatgatgatgtcaggggtgtccccactgtgattctcttagccttttctgcaagacagctgcctctgctctagtcatcacttctgtatttaaggaagagataaggggaagaagtaaggtccaccccaccttttccattgcatctagaaagccaaagtttccctgaaacatcatctttagctccctgctgcaagagactttcgcctacattttcttagccagaattgtgttatatgcccatccttagtgacaagggaagtttggaaaattaaatacttgtgttcatagactctattatagaggcaggggaggaaaacaggggccagaaatgagtgttaggtcaaccaagttacaatgtctgccccaggaacttatccaagaatagtatatgtgagaaggaggaggaggaggcaaggtacccattcttatgctcacttgagatgccatatttgatcctccctagcattcctcaacttaagggctgttctttcttctgcaggaagaaggcttaagatgtgaactggaaagttcttattctccactgagaactaattgcctgcagcaggtttcggctcacttctagttgtttactattttccaagtcactgtgattccagaaggtattgggcctcagtggagctcaaaatggatattagctcttgggtgtgtttcatcgatttgggcacaggagggaaattatacacagaggattgtcatcctggacagttaaaaatttaaagtaaatgaactgaacaaacctcctcccttaaatagtgctcagaaatcaaagagctgaaaaaatgtaaatgggattcattaagagctacaaaattatcttcttgtgttgctttgataagtttttcttgcaaatctctagaagtttagctcagggcaagtcttggacatggttgagaatgtctgccttatgaatggcgaagtggacaatggggaccagtgagaagaggctcttaatatgtgaccatcttaggatgccactggctcctacagcagtccccctggcactttccccttgctgtctctttctttgccttggtttgcagtgtttacacagcatgtccaagtgctagtttgagttaattttcattatgctcattttaacacaaaggacttgagtattcaagaatttctgtagtgctgggtttttactttctctgttggcaagaattacctttggttaacctttgtcttatagactcattgggtttcagttatcaggactggggtaaaagacctcctagacatgacacctactctgacagagaccaagaatccggcattgacaccctgaggctgtacttggctggcaggttttttattgttgtttggactgtgcagtgttttataatatttaagaatcacatttctgggctaggcatggtggcttatggctgtgatctcagcactttgggaggcaaaagcaggcttaagtccaggagttggagaccagcctgggcaacatggaataaccctctctctggaaaaaaaaaaaaaaaaaaatgttagccaggcatggtggtaatgcctgtagtcccaactacttgggaggctgaggtgggaggatcgcttgggcccagaaagtcgaggctactttgagtcgtgattgtaccactgcactccagcttggccaacagtaagatcctgtctcaaaaaaatcacatttctggctttttttgatcaacgagatttgatgatattggacaagtgtttggaggtggcaccatgggcaggagctgaggagcagctgcctgtttggatcatggcagctacagtcctcaccacaccctattgccttgcactcttcccatgatgctgatttaccaatctctgcatggccactttaggccctgcgttggtgtaccccatccagattgtctccattgtaaagccatatatttccaagggcacagcaggtgtgtgtggtatgctgagagtccccttctatctctccaccaccctctccatacttgctccccaggatggccatggatacagctacattagcctcacctgggtgcttcttagaaattcagaatctaaagctcagcccagacctactgaatcagaatctgccgtttaataagatccacaggtgatctgtgtgctcataaggtgggagaagcgttggtctaaagcacaattttcaaacttggctgatgataggaatgaccagggcgcttgtgaaaaacccattcccaggcaccaccctaaaaccagtcagagccgacagggaagggctctgagaatccacaggcttaacatgtgccccagtgattctaagacaatggtcaattaaaaagacttggcttgaagacttagttctcaaacgggtatgcatcagaatcactcagattgcttttcattttttaattaaagaaacataatttacaaaaatcacattattgtaagaattttaaaaagtcagatatgcaaaatataaaactataaaattgccatagttgttattttagcgtatcttaacgttttagtgtataagcatttttttaggtgtttgtgtgtgtatattttttaccaaaatgagatcgtaccataacgttattttcaaatctgattttctcagttaacaatctctatctttctataagaataattttcccatttgaccccgaattccaatttacagtgaattgttctgtctaaactaggagccaatccagatggatctggttattccatcctttatgttttttataaacaagcacattcttctcctcctcaatccctttattttattctccacataatgctgccttattgatggactggaccatttattctgcagatagtcccaccttttagacttatctggtcacttccttatggtgtcacatagcttgttgctctgtcctggggtgcctttgtttattctctttaatgcattttccaagactcccctcaaactccaatgaattaaagttttcagagtttggggcctgggaatctgaagtggttccactttgccaggtgagtctgagtttgagaggaaaggtgtcctagatcattcagcagcagcagaagagttggcccttaaatctacgaagaacattgccctgtgcatctgcatgcagacagggtctgataacatcaaagctgggagtctctccaacgctttaactaatgggatctgagctcggctgtttatttatagtcattcagtgataagaaagtcaacttggttggaaggagcttctgtcctaggcttgcagctggggccttagctacccttgtaattttcccagaaaaaaaaatgcacatctctttgagtcctgggccatgtgtaaatcagtggtaatacaagaaacatggagcaccccagaaaatcttcagaccctgagtttggagctgaggaactcagaaacactcaatttcatcgaagccccttcatacagctttgaatgcatacattatggggtctgtggctcagaggtaccagtgctcagagcagtatctgctttcctagtatggcctgtgggcagtggtctcagcatgcagcatcactgaacagaaccctgcatatgccataatttacgtagatactatggaggtggaaccatgtatggttaagtcccggggccctggagcagtagatcttaaccttattggacacagtatcccatttctatttacaaatacttttttttttttccatgagaacaaccacagggacttttaacttgcctaaagataatgtgtgattttgagatgtgattagggattatcattcccacagtgatcctactatcaacaggaactgctgtttctattatcaacaagaatatgcctccaagccaggagtcctgctgatcccactgtctccccaccccaacagccatggcccgagatcagattgtctccatggattctagtgctcagggaagttaagaaaactcaattcacggtgctcagttcaaccttagacatgcatcagaatcactcacattgctgtttaattttttaattaaataaaaatatttattcagccgaggtagctgaagcaggagaaggaagagcctcaactcaggggaagatttgctgtcaccccctgacactgagcagaggccagtcaaatccactggagctgacctctttgatgtcaggctcagcagaggcctggctcttagcaggccagcttcctgtgcttgggattgcttgtcttagctttcagaggatttaattgctgattcaaaccatacaaagtacaacgaacagtatctactggtgggttgaacaaatgggttccaatgactcaggcccgagtgacctctgctgcctctaacctccttcaccatctgctgcccagggggtcctgagaggccaataagtatctgccaagatgctctttagtatccttctgtgacattcataagatgttaacctgcctacacacttttttttttttttgagacagcgtcttacccgtcgcccaggatggactgcaataacatgatcttggcttactgcaacctctgcctcccgggttcaaatgattctcctgcctcagcctcccgagtagctgggattacaggtgcctaccaccacacccagctaatttttgtatttttcgtagagacggggtttcaccatgttggcccggctggtctcgaactcccgacctcgtgatccgcccgcctcagcctcccaaagtgctgggattacaggcatgagccaccgtgccagccacacatttaaaataatgataatagtaagccccaattatactataaaggaacaactaatttagaataggaggtctaggtaaatatgcaaatgcaaatactctggcgcaacccccctggaaaacataatgaagtggtcccgccagagtatcctcacacagggtcaccaccaacacattgcatcagctgccatgcagacgaacacaggtctgttttgcattgtcacccaagtgacattcagtattgccattggttaggcaattttccagaattggtgagattctgaaccaaacaaaaaacaagatcacctcttttgacacagggtctgcattgtggtgatgtgtggaatatgttcatctgtacgaaaatatttggggtttgagtgtaaaatcgagttgggttctagactcagataaacaagattttttttctcccccacccaaagactgtttatcagggtcattcgaaatgtatgtggggcaactctatgtagtcaggagctccatgcatcgcggggtgtctaacacctaattgtcacctcccactaaatgccagtaacacccccgattattgtgacactcaaaaatcgccccctcgcacttcgaaagcacacccctatacacactgatcttctgttaaccctgccttgaatgacttcggtagcctgaattcccatcctggccccactgcctcatagcttcgtggccctgggcaagcccacaacccccaaacctcagtttcctcatctgtgatatgggtgcatggaggaggttaaataacagctccaatcttaaagcctccttagcgccgtgcctcacgagctgtaagtactaaatgaatgctggctattatatataacttatattgtatattatttatgattgttcctaaaattatcactaataagtgcttcacagcaatgagctaagattctgagtgctatttcatggattttagagaaataattagattctagaacctcaattatcatcgtaatgactcccctgatagagttccaaaactgtttctttgtgaccactcacagtaagaacatcacacgaatgaatattccacctgtcttaggtgtgcacacagaaggtactgacggttctctctgagcagttccaagccctcatctgggaccacgtcttcccaagaccaagccctaagtcgtgatataaaacaagaaaagacgctgggagtacagtcagcttcaaagacagaaccagcgcacgaggcagaatcacagtgtcagagcttctgtaattacacgctaaattatgcggtgccatctttaaattatgtaggaaatagaaaaaggaaaatctcggtggaggatggaggtagcttctagaaggaggtgggcctgagccgcccctgaagaatgttgggaatctgggtcaggcaagaggctggaggagagaggtgaagagctggaaggaagttgggaggggagaggcccaggggagggcatagatggagggtgatggggtgtgggtgcccaggcctgggaattcagacctgccaatagccctttcaagggccagagacagttccctgccagaataaatacatagataaatactatttaaagcaaaaacaaagtgtcaccaatatctagataaagtgtccccaaggatacatctggtgctattccgtgagaccatgtcacccagagctggtgctaaactgatgccaaggggtgcccatggaaatgccacctttgggtgggcagaggcatttggctctgcactggtttttatggtgtgggaaaggaagcattctcgtgggaatattgttcttgcctccaggaagggctgtgggaacgtgcagttactgcagagggacatttctgagcatacatgcttgtttatgatgatggatgactggctcaggagagagctaaaatgatcctttccctagagatgtgaggagaagccagcccagaatttctgtcacaatctgctgcccgagtccagtgactcagaaacaaagttcatctttactgacgtgccatggctgccaggaaccagggcagctgctaagccaccaatccccagcccacagttttgtgcggaggagacatagacatatatgttattgcaattatggctctactgaaagaatgaatgaatttaatcgaatcaatcattcattcaattcagttgaatcattcattcattgaattgaatcattcattcaatgaatgaatcccctggtcaaggaaccaggctcagcccacaatgtatgcatttattcattcattcatttaacaagcaatgccaggcttctggcctcagggagtacatgttcaccccctagtggagggagacacacagtaaacatagaatacattaggcaatgagaactgtagagagaagcaagcatgaagaggaacatagaatactatgcagccataaaaaagaacaagatcatgtcctgtgcaggaacatggatggacctggaggtcattatccttagcaaactaaggcaggaacagaaatccaaataccgcctgttctcgtaagtgggagctaaatgatgagaacacatggacacagaaggcaacaatgaacactgggtcctacttgagggtggaggttgggaggagggagaggagcagaaaaaaataactattggttactaggcttagcactttggtgaggaaataatctgtacatgaaacccccatgacacaagtttacctatatagcaaaactgcacatgtacccctgaacctaaaagttttaaaaaaaaaaaacaaaaaagagtgaacagtactgaagtgagagtggcaggggtgcggttttcaattgcgtgctcaaggaaagctgcttgtctgggaaagcaatatttgaacacagcctgaaagaggcgagagagtgagccacgtggataactggaggtacagcaggccagacagaggcaacagcacatgcaaagtccctgaggcaggcacacgtgtggtgtactggaggaattgtaaggatgtgggatggatgaaataaagtgagaaggggagcagaagcagggggagcagatcacatccaactgtgcaggcgtagtaaagaacccagcgtttactcacaaggaatggtgagccgccaaggttttgagcagaagcgtgacatgacctgacttgcattttataggacctcccttgctagtgtctggaagagatcaaagtggatgagaacaaaagcaaggcagccattgaggagggtgggacagttacataggtggattgagccagactggtagcaatggagggatgagaaatggttagtatccgcaggggtttgaaagggctgactgatttgctgatggatggtgtgtgtggttcaagagaaagaaaagtcaaggaagggccaggcacagtggctcatgcctgtaatcccaacactctgggaggccaagacaggcggatcacctgtggtcaggtgtttgaaaccagcctggccaacatggtgaaatcccgtctctactaaaaatgcaaaaatttgctgggcatggtggtgggcacctgtaatcccaggtacttgggagcctgagacaagagaattgcctgaacccaggaggcagaggttgcagtgagccaagatcgtgccattgcactccagcctggacgacagagcgagactccatctcaaaaaaaaaaaaaaaaaatagctgggtgtggtggcatgtgcctgtaatcccagctacttgggaggctgaggcaggagaatcactggaacctaggaggcggaggttgcagtgagccaagactgtgccactgcactctagcctgggagacagagtgagactctgtctcaaaaaaaaaaaaagtcaaggaagatcaaatactcaaggctcctagtgatcatcaattagacatccgagttcttctgggaggtcctgtttgccagtggtcatcctgtcatttccatcagtgatgtctggaaggtttgataccaagaagttacctcctttcaaagtggcttcttcttccagctactaggtttgacctcctggaggccaggagtgcaaggtacaactattactcttccagaagaggctctccccaaccctcccacattgaagggttgacattgaagtgttgaagttttccttcagcctggtcattgctcaaaggtggtagaatatagatgtaggtcagtagtgatagcaggctacagccagccggtggtcaccacagggtagatatcacatagtggttgaaactgaaggcggctgaaacctgaattctaattaatttctttgtgaccatgggaagttatttcacctttccgttcttttttttaacttttaagttgaggagtacatgcacaggatgtgtaggtttgttacataggtaaacgtgtgtcaaggggagttgttgtagagattatctcatcacccacacattaagcctaatattcagtagttatttttcctgatcctctccctcctcccatcctccaccctcctggtgtgtgttgttcccctctatatgtccacgtgttctcatcatttagctcccactatgagtgggaacatgtggtatttggttttctgttcctgtgttagtttgctaaggataatggcctccagttctgtccatgtctctgcaaaggacatgatcttattcctttttatggctgcatagtattccgtggtgtatacataccagaatttgtttatccagtctatcgttgatgggcacttaggttgattccgtgcctttgctattgtgtttcaccttgttgaacatcagttttgtgagctataaaatgggggtaatccattctctacctcgtaggattgttcagagtatgataaaacactgtgtctggcacaggaatgtcaatgatcagctattgagtaagcaaagtgaattaatgatctttatatgccatgtgtcatgtaattctatcctctcacttccaggagatttggaaggcagccaggagtccctctttcctctctgttgcctggctgacctccttcctttaaaacccttctcctcttttttgtatcataatgaccttattttgaattatggtggtactttaaattttatgtccctgaagggttaagctctatgttggctttacctgaactctctcatcctcacccaccagcaagatgaaggtagggtggccactgacaggtgacgttcgtgaggtgcatggcttttctgaagataagcagtaattgaaggaggagaatcagatttaaagcctggggctgcaaggatatgagattcatcacaaatgatgatgatgatgatgatgataggaacattaggggaggagcaggagtagggggagactgggagacacaaaacatgtgttaccagactttgtcagtagcatttttcatggtttcacatttttaattctcacaatgaccctttcaggtagcttctatcattgtcccaggttccagttgaggaagctgaggctctatgaaatcagataacttgcccatggttacacagctactagtggtggtgcagaattgggaagccaagcagccttggctaaaaagcctgcagctgtgatctatgtcctcgctctggccctttctcctggctttcctgatctcaccgccgcccccttacccccactccccagcatgtccctcctcggccgtgggcaacccctccttctttggggacacacctctctcaccaagttgtgtttccccaaggcctttgagggtcacagtagtacatttctcactttgattatgaggggatacaccctcttaatctaagacaaaccaccaccaccattatactgaatttaaaccagtcaagaagttcaacccttccagctatggaagccaaggtatgttctcactttgtcttggtgcatttgatttctctgaagataccctcagatgctctaatttgagaaaatactagaaagtgtgcatttacaggtgaccatccctctgctctgttgtgacttttataaggtctagttgttcttgatatgcagactaatctgtaaggaagatgagcatgggggagagaagaaagacgcattattcactggaaaacagcatcgtgtattttagcaaggagagcgtgctggtgttgatctgatatcaccccaatacttaggaggaattgagttagagatacatttgtagcttgaagagttgcttatttgataagttatcggagtgtgtttcaaagacattatgcctatgtgaaagtaaagatggagttgtttatctctgtatctccttgtcctgtttctcccaggacttggcagaactcttgatggcaagaatctaatctttgtcctacttgtaactgcagtgcctggcagtttgccctgtccatattcatagagctaaagaaacatttgttataaatgaagaaatcccccagagagaaagctatagagaactgacctggaacaatttacttacctgctgggagacgctagtcttgccccagatgttcaatgcctgcactggtctatttgcaggtgcaggggaggcttctgctgtcctggggaaaaaatacccatgtcttcagccagccacaattcaattactctagaccagtgtatccgaagcttgagtgtacagcagaatccccaggaggatttgtttaagtactcattgctaggcgtactaccctggtttctaactcagttaggtatattaatttcctagggctgccataacaaatcactgtaatgttgatgtttaaagcaacagaaacttattctctagcttctggaagccagaagccaaaatcaaggtgttgccaaggcatgctccctttaaaggctccaggggaggatccttccttgcctcttccagctcctggtggctccagggattccatggcctcagctgcatcattttcatctctgcctttgtttttacgtggcctcctcctcttctctttctcaaatgtccctctgcctttctgttacaaagacatttgctattggatttaggaccttcctagataatccaggatggtctcatctcatcttgagattcttcattacatctgcaaagacacacccccacttattttccaaataagattcatgcacaggttccagggataaggacatagaggtatcttttagggagccaccattcaattcatggcagtagacctggaatatggggcctgagattatgcttttttgtacttctaacatgttcacagttgatgctaaaagttgctcagaggttggaatatgagagcttggactgctgctccaaagagagagaaaataatacaatgccttctttgaaatagcaccttttcagaagagttcttaaaatagattttatctcatgggattgatttattgtgcccattaagccagatgcatagctcttctactagaattaattttaaagttgctaacccttaattatttgcagagataggacaaaaaatgttggaagcaatttggaaatagtctttatgttcagtccataatggatgctatttacaacaatggctgtttcatattctcatataaatgatgaagctaacactcaaagccatagaccattcaaatgctttatatcctaaaaaggatacaaagaccatcagaccataaattgtgatttttcattgccatggcatgtttcaatagatggtttgtttctgtagaaagaacagttaattctggactcagatcctgaacatgctccttttttggctatgagaatttgggtcttagttttcttgtctaaacagtgtgggtgataatattttgtcctaataattagcaggcttattatgatgatcaattaagagtactttgtaaactgtcaagtgttttgaaatatgttacttctgtaatgacaaggttgaaaataaatataactggagctaattcatagaaatctgtgtactaaagatagatcttaagaaaaattttcgtccaaagtgtatttgcttactgcagccctttcagcttctcccatctgtcagatggcctttctcaaatgtgaccactatgtctctctcccatcccacatggtcttcttcagtgtgaccttgacgatctttcattgagatatggggactttgtctcatcctcttggatctcagtggatcaaggactcactcgtaaccagtagaatgatgtgtgacttctgagatgaggtcataaaaggccatgcagctttctccttgttcgctgggaatcttgcttttggagtccgtctgcttgaaagccaccatgttgtgaggaagcccaaactaaaccacgctagactctgggctccaggagagcacagactcctttgctttgtcctcaccattttaccccccgccgcatttagcacagtgcctcacacaagcaggcattcaaacagctgtgagagtgaagaaacaaaaggaggttgtacccaactcattctaatatgctctcaagtttaaatatgtgatgtaaataggacattataagaacaaacaccaaaaaaccacctatgtgttgcaaaagttaacattattaatcctctagaattgtatggtgcctaatggttacatctgttttcttaatcgttcccttataatgcctgtcttatagtactgccaagaattagaagggaaggagcatgctgaggcctagataattctgatgggtttttttttttcttttttggaaaggatttaacagatattagagaaaacttagagggagtcttgggactccttgatggccacgaaagggatgacttttaaagaaatcgatccagaaatgtctatgtggctgccctttctcttctcgttgtaaattttctcacagtgaacacaggtgttagagatcaagtgtttggctttctggtgctctgatgcaggaagtttgttttctcaggcaggcttctcagctcttgcacagtagcctatgggttgggacggctaccggatggcccaactccaggatggggtcatagtgcggagctctgtgagtggtgccccctagaggaaacttcctgaaggaatgaagcttcctgaactcatgcaatttggcaaccctgggttctccccaatgctttcaagacatagtaggttggagcaaaagtaattgcagtttttgccattgaaagtaatgtcagttacttttgcaccaacctaatacaaaccatcccatatctgtgttctccatcctttcatcctttatcacagtggggttgtgatagatccctgaaaacacaggatcaagtataggtaaatgcaagatggtacatagaatcaagtgtgaaagtgagtcccatcaacccacactctttccatttggcccagttgctgcccttgttgtttagaatggcacgtacctggccttgaaatgcactgaagcctatggggattactttaaaattcggtcctgtaagccagtctgttagtatcattgctcctactaatgatagaaattgctggtgttggccgggtgtggtggctcacaccagtaatccaagcactttggcagacggaggtgaagggatcacttgaggccaggagttcgagccagcctggccaacgtggtgaaaccccgtctgtgcttaaaaaatacaaaaaattggccaaatgcagtggctcacacctataatcccagcactttgggaagccgaggtgggtggatcacctgaggtcaggagttcaagaccagcctggccaatatggccaaagcccgtctctaccaaaaatacaaaaattggtgtggtggtgtgtgcgcctgtaatcccagctactttggggggctgaggcaggagaatcgcttgaacccaggaggcagaggttgcagtaagccgagatcacgccattgcactccagcctgagtgacagagtgagactccatctcaaaaaaaaaaaaagaaaaaagattatataaaaaattaaaaaattagccaggcgtggtaggcgtggtgggaagctgaggtgggagaatcgtttgaacctgggaggcagaggttgcagtgagctgagatcgcatcactgcactccagcctgggtaacagagcaagactccgtctcaaaataaaataaagtaaaataaaataaaaataatctgtggtttttcctcagcatgccctttatgaactgaattatacaaattatatactttaaacctcacaacaacctcatgaagtgtatataccagtaatattcccattttatggacaaaaaaaagagaaaaaaaatagaggcaccaagaggatcttacccaaggatgcgtgactggtaagtagcagagctagaatttgaacccaatctgttaaacagttccctcaacaaagaattatctcattttgtgcttgactctcaagcattcatgtaggtgaaaaacttctttagaattctctgagccaagaacctagctctttgtataaacattttttgtatgattttaatctgcactgaatatattcgtttcagtctcatattcatctggagacccctccagagcttgaggtcttgagaagtcctggggctccagtggccactaaagcaatgacttttcaaaagaaaagaaatgtttcctgagtgtagatgttgctatcttttttctttctcattgtatacttccttgtagagtacataggtgttagaggtcagatctggagggattttgtatccaggaggttaccttgaactttgatgctgtacactagcctagtattattattattgttgttattatcattactcctactattactcctcctcttgctgctgctgctaaagtagcaaaactgtctggctcccggagcgccacctattgaccatatagtttgccacctgtctcagttttgtgccatgcatgagctcatcctcaccaattattggcaagattatagaacaggacacagagtgattcaccttcagtatagctcccactagtgtgttgctcttatcccacaagaacgtgactatccaggattccttaaatccaccaggctctgagccagactgcatttaccaatccacagaaatagtgcagaccaattccttttgtgaaaattaacatatattttgtctatggccttctcttcatcacttgccccagcaagtctctcctcaaaggatagtcagtttggcatgatttatgtatgacgaacccaggtagactaccataactcactgttctcattgataaatcgttgataatatatgccttgtaagttggtgctgtttggatggcatgactaaagtcaagcattagcatagtgcccaacactcaggaatctggcagaaagtcaaaagttacaccgatcagtgtcattattagtatgcaatttcattcttagtcttcttgggatttaattgtattacctaatttatgtaatgagactatattttcttttctgtcccatttctattaaacttagatacgtccccttctccttgcttatggaatcaaatttttaaattaatttgatttgggttctattttctaatcccatcaataaccagctacaatctgcccttcaggaggacgctgcttcttaaagcatgtctgagctcccctagccaccctgatttataatgtgatatttaacaccctcagctgcttctgaagcccaaggggcaaactggttacctagcaaccacatacacacactagctcatggcgcaggttagccccattttgttataatgaaataatacgtcttgtgagaatgaaaagctaaggtacactatatgaggttagtgttttggagaaaaatgggctctttaggacagattagcaaagcaggagttgtgtgggtcaccccctgcttcacagtgactcaccacttcctagaatggaagtcacgaccttgaaatcctgagacttggaggaaatagaggatatgtttgatgtactgaactgtctttaaaaataatgtaaatttagcactttgggaggccgaggcgggtggatcacgaggtcaggagatcgagagcatcctggctaacacggtgaaaccccatctctactaaaaacacaaaaaattagccaggtgtggtcgcgcgcgcctgtagtcccagccactcaggaggctgagacaggagagtggcgtgaacctgggaggcagagcttgcagtgacccgagatggcacaattgcagtccactctgggcgacagagcgagactccgtctcaaaaataataataataataataataatgtaaatgtagaaacctttgggggagtgagcagtccccagtggaagtataatttccaggctatctcacacaagcctgcttggccccaggacatcctgttgtgatggagaacatcataaagctcctccaccaacatggaatccatagagaatattcttacctagatacaaaaagttcagtattctatcatgactttaatataagggaaaaataaaaggaaggtgatttacaataaaagaatgcacacttgaaatgttcgggcatgactacacaagaagatataatgacacagccaaatgtttgcacctatgtgtaataaatcaacttgaatttaggagaagtaagatgattcagaaatgcatttctttttttccagtgtctcttctacagaatattttctgaatcataatcattgcagattaaaaatcccacaaaaaatgttcatacaaggagtcaggctcttggctcagaaaattctgaagaagtttctcgcctccatgaatgcttaaagagtcaaatacaaaatgagataatcctttgttgggggaactgttcacgtttcagaacttttggcatcctttgctccacctgcagagagccaacaaaatccttcactaattttaggaaccaaaaaacaaatttccccacttctcagtacagccttcaatactggtctgtcatttctgcctgaccttgtttcttctcccaacacatctatccatttgttgattcattcactggttatgcttataacgttgtcattatatccttgtctcagttttcttatcagtaagggtaagcagcttcgcagaattttaggaaggattaagtgatgcgtgcaaaatacttagagcccacaagaagaacttgattaatgttgttcttattattgctgtattgaatgtatcctttagtactttctttttgtatagtaccatatggcatagatgtgtgtgcacacaccccctcacacacaaatacacacaccaaatatttcaaaggaatatatagtgaaaattcctcctatgtgcctaaatcttcctcggtacccttccccagaacagccactgtgtcttcccagaaattgtgttaagaaacaaacatgtatatccttttgtgctgtgttttgtagaagtggaagctttctgtgcagccagttttgcattgtgttcctcaccaacaggatctgtcggacgccgtgtatatagttcttcctcattctctttaatggctatgtgatgttgcattttatggatgaaccataatcctcaaaaacattcgttaggttgtgttgataacatagaaatgtctaaagcagtgaacaaagtagcccattatctcaggacccagataaccaagttaacatttttttagcaaaataaaagtagaagatgcagatgataaaagtaaaagcaggtcagtaacagtacagtaagaaaagtagaaatctcctgtcattttctgaagtcccaatccctctagctctcaaaaaaaaaaaaaatcttaacaattctatgtgcattctttcaggaaaaaagcaagatagaatatggatatactagctgtgtaagtagctgtgtaagtagctttgtaggctgaaaaaagcttatcccccatccccctggaagatgtgcaagtactaattcctggggcctgtgaatgttagcttagattgcaaaagggactgtgaaggtgtgattgagttaaggatcttgatttaaagaagttagtctgatacgcccaatgtaaccacaagggtccttataagaggctcaccagtggtcagagaggaaaggtgatgttgtcctgctggctttgaagttggaggaagaggccatgtgccaagagatgccagcagcacctagaagcaggaaaaggtaagggaacctcatgtcactagaaggaatgtagccctttggattcattttagactcccgacctccagaactgtcagagaatacatttgtgttgttttaagccaccaaatctgtgataatctgttacagccgtaggaaggtaatattttagcgaatatttttatttgcataagtaccacactctgtatgtgcactgagttgttctttactaatagtgccatgttatctaatttttcacaggcatattcctttctcccaaattaggtttacaagcaccttggaggcagaggctgtggttggtatcacgttgcattcctcccggctcttctctcagcaggaggaaatatagctgcttagttaaaaataaaaaaggattctgaaggcacacagttcaaagttagaacaggcagccaatgcgtttgatgtccttgagccacatgccctcagcccacctggatctcggctgcagctgcattgggcactcccaccttcttccagcagcttctccccgcttttccaggaccaagaaaattctttgccagcacatagtagccccaaatcaaggaagctaatgtcctcagaggtgacctccagccagtggggacaggggtcagtggatcaatgcccaggcccctgtctatgaaagggcaattctgagatgtgctctctgcaggtccccagtaggactgagctgcggtagcgcccggtggtaaccagcttagccacacagctgtaagaaatagttttctccttccttatctccctcttctgccttctcctacctgcttcctgaatctcccaccatcctcaaaagcacgcctacactcaagtctttgtctcaggctcagcctggaggagcccaagttagaatggaaccccagctctctttctttccccccccgcctctctctctgtctctctcccctttctctttttctctctctctctttctttctttcagtggagtcttgcttcatcgcccaggctggagtgcaatggcacaatcttgtctcactgcaacctctgcctcctgggttccagcgattctcctgccttagcctcccaagtagttgggactacaggcgcacatgccaccacggccagctaatttttgtatttttagtagagatggggtttcaccatattggtcaagctggtcttgaactcctgacctcaggtgatccacccgcctcaacctcccaaagtgctgggattacaggtgtgagctaccacacccagccagctctgcctctttctagctgaggattctgtaacaagccagtcttctaaaactgaattttttttgtctatcaatgaagatagcagaatctacctcaatagagtattgtacagtttgaaagagataatgtatacaaagtatcttatacattgtccatagctactattgttaaaattagtttatgactattacatcatagtaattgctttctaaaaagtaacttaatgaaacacatacatcaaatgcctgatgaaagctgaattttctaaaattggtcttggccttcaaaagatttctcattccttctaccatgtatattcaacagataattttgagcgcctactgtgtgccaggcagccctctgggagcaggaagactgcagtgagcaaagcaaacaaaactcccattttcctatgtcagatgcaagtggactcattcagcacatgctatttgcatcctggaggtatcaaggcaaagaaaacacagtttttgcctccagaggcataatcttacctcctgcccgtttatttgaaatacacacagttgaaatattgttgtaggtttatcgattttctatatgtttattaggctcctgctatatgccaagtactgtggttagcaccatcctcatataaacattatcatcttagcccctgaacttaaggaaatgtccaggctgctaaagcagatctgtgaaaaagctcagcctgctttttttcagctagactactatgactctagctcagaaaaaaaattatttctaatcactggttctaatacaaataaaatgtagtgattcattaatctccttagcctataattgcaaattgagttttctttcaaatatacctaaagaaggtaggtgcccactaaacatttcaggggagttttatttaagctgcaaataaaattagtttactcatttttaatttaattcccaggaggcattttggaaaccttccctcctcatttgacccaaaatcatttttaaaaattattgttctcctaaattgaagccctttccagcattgcgcattagaagtcttaaaactcatctgttttctttttgtaattgacttacaaatgcgtaatcgactcacaaatgtataactgagtatgcatggcattttaaaagggcagagtttccatttgcttcttgatttctttgggggttctcattttcctaagccctcttcccacaacattcccagtcattccttgggtcatctctcaggtgtcaccaccctgctagcatcttaatggagcggctgtgtctcctcccagcagcagtggcaccagaagatttagctgtgttggggacaacgttcagaatcctcatttgctgctaaagatgtacccggtctcattctcctgacacatggatgatgatcttgtgacccgtgtgactatgactgtatcactctgatcatcactagaacaataagtaatctaaataataagaaattctgcatgttccattgacaaaactgggaacactgcacacacatacacatattcacacaaaccatatacagtcacgtgtcactcaacaatgggtataccttctgagaaggtatcattagatgatttgtcattgtgcaaacatcatatagtgcacttacgcaaatctagatggtatattctgctacatgcctatcctgtatgacattgcctcttgcgcctaggctacaaacctgtacggctgttactctattgaatactgtaaacaattataacacaacagtaaatatgtgtgtatctaaacatagaaaagataccataaaaatacagtataaaatatttaaaatggtatccctgtataggaaagctcgattataatctaatgagacaactttcctatatgtggcccatcattgactgatatattgttatccagcaatgactgtacttaagtaactttaatagaagcatgaagaatgtagtagttgtcatttgaaaagggccttgctaaatgtaaccttcagttaaagcaagtcagcctagtggaggatggtggctgctcatgttgtcttatgtggatataaacctatatatccccactaagtgtgaaaagatgtcatgcaccaggaagcatgcaggagacttggtaaggagacagagggatgcagagactaagcccaaggctgggagcacaaggcttccttccttggtccaggtgtttctgcatgggaacagaagattggtgtctgcttttcagtgacgtggctgaatcagagtgagtgagtgggtggtttattgttggtttccacagatgctgatgctgaggcaagaaatcaagtcaaaattggtttattttgggaggtacaggaaacaccagtagaaaagtgaggaaataagacaggggagggaaggcagccaataacgtaaccagccagctgctttcatgagagactggagcatcgtcccaccaggaaacaataaaaaatagtgtaaaaacgcataagcttcagagaaagatatgggagctggggagtggatatgccaatcccattcttgactgattgaaggctgctgctagggacattaatcccccagcactcctgggctaccatgtgccaagcagagctgcctgctgtgcctttggggaaagccctcatgcagcgacacggggcaatggtagttgtctgccttgtgaaggagtaagacccggggctatgactagggtatcagcagagcctgctccaagaatggttaagggtttggtttgggacatgtagagttcaagcaacctgggaggcacctaggtgatgtgactcagacctctgtcaatactggctggagtttcaccatcaatattgatctgttgagtaatctacccattgtatgtgctttatagtgactgaattaccaacatgcatctgcctagcctatttccctcttcaaaatggcatctcccacacatgaaacttcctccttgattatatcaaacaggaccaataaatcattcagcttttccccagaagtgggatgttgagtggtacaatccatgatgtgccatttctcaacaaggcagatgatatttgattcttgggatatcagtaagtctgggttatttaactggctttttttctaaatcctgacttgtgtccagttgcttaaccagatttagaagaagccatgtttacatggaatttctgaattacaagctgagaaatgtttccagaagatattttaaagcctccttaagaaggctagtgggccttatttcctgtgtgaaacaacttttatcaaaatgtatttgacactgggagtgtgggtgaactggtgaaaaggtccctgagagttcgggtccctgagagttgcaagcacaaatcctgttaacaggtaataagattatgagcatagcccatgtagagcgcatggttttatcagctgaagtgaagcaccaagatgccaagttgttaatggaattcagcatctgtgtctttcatgggtctctaaatagacaaggttcaatgctacccaaatttcctgcagaatcaaaaccacgttcgcctttggaatgggtatttatttattgcttttactctggggaaaaaggcttttttactttataacctttttatctcttatacagcaatttccttccatcttctaaaaatgttagaaaataaagcaaatatgaaaattcatgttgcatttctaagcatctgaccacaatctatagatcaagataatgccagactctaatttcagtgtttagcaaggttactggcaaatagcatttgagaaaagagaaaaaatagtatattgaaggcaatacccaccccctatattttgtattaccatcttttgtaagctctggtcatgcaatgctatcataggatatttttccttccttcttttatgtctttttgggtcattttaaatataccccatttatatatgctactcatagaaattagttctttattctccattgaacttttctgaaaagtattataaagaaggttcaatttaattatgttcaagtaactgagtcgttggcaatcagctgccaacattttgattgttttcttgtgggattcagtcctagtattgagtgcccactaacaactgccaaatttagtcatccaaatcaccacgacaataagctccaggtattgaaacatcaagactgaagccaccacttacgatccaatcaacctttttaactgtcagtgcttccagtctttgccgaaatacacagcattaaaattcataagtcaacccatgtccgtgcgtgctttttctctcccatatccagttggtcacttgcttcatgctgatccatccatagcggtcgtggtccacactccagccctcctttacatcctccagacagatagggttctttctatggcttaaaggtgccaacctcattcctgtctcagggacctcacacaattgctcctttagcctgaaacaatcacccactaatctctgcatagctgagaccaccttgttattcaggtcttacctgaaatgtagcttcctcagagaggtcttgtctggttaccccactgaaattagcatccccctttactgtgttccattaaacctcccacttttctttcttttgaagcatttaccatcatccacaagcatccaatgtatatcaccgttgtgtggtttattgttggcttcttcattgctagaccaagagctccatgaaagcatgggccttgtctctcttgttctcagtgaaatcatatgtgctcaatatgggggttagcacatagtcaatgaatattcaaattcattcatttaaatatttaaatatttaaaaaataaatattgagatacactaccattcatttggcacacagcacatgctacttttaattgtgatggctcaaataacctatgatactgcaaagaccatttttatgcccttataggtcatgtagtaccttttgttctctgatatgtccctagtacacattacagtgtttcacacagagtaggcacttaaacataccagctagtggatagtgtgatgatgccaggaagtaatatacaagggtaggaaactaacaagtatggagcatctcatatgtgtactggcatctgacttctcatttagtcctcataacaagtttataaggtagatagtaacatcccacattacagaggaaaaacacgagcttgtaattgcatgataagcgcataaggagcaaatctggaatccaagcctgtgttctctgcagggtgccattgtgctactgacagtgtgctaagtttaggttctctgtggatgtttgtgaaggaggcacagggaggcaaggagagccacaagctcatggctctatggctggaacttcataccattaatgaccacttaagaacgtgctgaatgcacctatgcatgtggaatcatgtacttccttttcacattgtaaatgtgtctacaaaggccaggcatggtagctcactcctgtaatcccagcactttgggaggccaaggctgatggatcacttgaggtcaggagttcgagaccagcttggccaacacggtgaaaccccatctctactaaaaatacaaaaattagtcaggcatggtggcagacgtctgcaggctcagctacttgggatgctgaggcaggagaatcgcttgaacctaggaggcagaggttgcaatgagccaagttcacagcaatgcactccagcctgggtgactgagttagactaggtctcaaaaaataaaaataaaaatgaataaataaataaatgtgtctacaaacagaggtttttgagagtcaggcataagcccccaccttagtgatactgatgcagccacctcgaaatgggaggtgggtcacccatctttatttgtggtccccgaagaaagaagatctcagcggggagaaggtggggtggggcacatcaactccttgcaggtagacactctgacaagaatgtatgcactactcaaaatgtttcttacccatggttcctaatacggtgaagtcatgagcccccttaagacccagtgaaagtggaacaattccacgtgcacataagccatgcatttacgatttcaggacatctttgaacccagggcaagaactgcagctttgggaaattcccagaacagtaaacagtgtaaattctcaaaagggggtttatttcatgttacttccttttttaaagaaatgtaactgtgttgtattaccattagacgtaattgggtgagaaattacttataaacctgtcatcataacatagctattgttttctttgtccaatatattgacattttattccactgtgcacgtagagttctgcatttggctgtttttacttaatacatcatagcatcaaacagtggtaatgccatttcacagtctgtatttaattggaagtgttttagtataatgttattgtaatactcaaatgcaaaggcacggtgatgcagtgaagattggtttctgttttgtctaaaattattgtagaacccattaaattttgtaatgcacattctcttccatctacaggtctcccataaaatagcttcaaatctcacaatcaatgatattttaaagcagcacataagagtatttagctttaatgtgatcattgcctcaggctgtaataaaaacagaatttttccccaattattatcagtcactcctcctccatagtccatcatgataaaaccgagcgactttcattcctcaccaggcaactaatcatccctttgctgagcattcttcataaatggaatggaataaatttcattatgcaatgcggtaatgttccccaactagagatcggggtgtagcaatcttggggaaagttacagtcaagattattaaaatatatgaaacttaaagagaaatagtgtcctaatcatgcagcccataataggctgtgccaaccccacttatcctcaaaacagccctcccttaccttgccggcctcatctaaatgctgctgtctgcagtgcacggtggctcatgcctgtaatctcagcactttgggaggctgaggcgagaggatcacctgaggttgggagttcgagtccagcctggccaacatggtaaaaccccgtctctactaaaactacaaaaaaaatttgctaggtgtggtgggcacacacctgtaatctcagctactagggaggccaaggcagaaaaattgcttgaacctgggaggtgcaggttgcagtaagctgagatcactcaccactgtactccagcctgggcaatagagcgagactccatctcaaaaaaaacaaaaatactcttctctcttgttgtcctttgtaaacttctgaaaattagacaatacttgattcttttacttccctaacaagtacctgcttaccaacctgctatagttttatagaagtactctctgaaaaggtaccaaaaatattctcattcctacatccaatagctgtttttcttatttggttggaattttccatatgaatcaacatgctcaaccattttcttgaggatctttttgtcgtagcagttgttgtttaaaaaacaactttattaatacataattcatatactgtataattcacccatttaaaatgtgcaatttaatcttttaaagtatattcacagggtgatgcaaccaccaccacagtctgattttatatttttagaggaaacaaatatatatgtttatatttaaattttattttattgtgataaggacacttacctgagaccttaatagattttaagtgtacagtagtattgactctaggtacagcattgtatggcagattgctagaaccccttcatcttgtttaattgaaactttatgcctgttgattagtatctctcaagttttccctccccctagaccctgacagacaccaattcagtctttggtttgggttatatgactattttgagtacttcatgtaagtggaaccatgcagtattagtctttctgagactggtttatttcacgtcacataatgtcttcaagattcatccatgttgttgcatattgcagaatatccttcacttgtgaggttgaatcatattttattctatgtatgtgtcatatttatccactcatccatcactgaacatttaggttgtttgtacctcttgtgtattgtgaatagtgctgcagtgaacgtggtagctctccagtaatatcttcaaactatctcttgaagatcctgatttcaatatttttggacaaatacccagaagtgggttgctgggtcatatggtagaaaagttggttttttgaaaagataagcaaaattgacaaacccttagctagactaaggggaaaaaagagagaagattcaaataaataaaattagaaatgaaagagggaacattaccacttataccacagaaataaaaaggttcataagagacccctatgaacagttccctgccaaaaaaaatgaaaaaaaaacctaggtaacctagagaaaaatgagtaaattcctaaaaacatacaacctaccaagattaaatcgtgaagaaatagaaagtccgaacggacccataactcatagggagattgaatcggtaaccacaaattctcaacaaagtaaagcttaagaccagatgtttggcccaccaaacatttaaagaattgatgagaatccttctcaaactcttccgaacagctggagagggagtgacacttccaaactcattttataaagctagtattaccctgacaccaaagccagacaaacaccacaagaaaagaaaacaaaagaccaatatccctgataaatgtagaagcaaaagtccttaacaaaatactagcaaactgaatccagcagcacattaagaggatcacaggtcatgatcaagtgtgcatgggagtcaggaattgttcaacacacagaaatcaatcaatgtgatacaccacattagcagactagaaaataaaaaccacatgattgtctcagatgcagaaaaagtacttgacaaaattcagtgccctttcatgataaaaactctcaaaactaggaatagaaggaaagtacctcaacataataaaggccacatatgaaaagtccatagctaacgtcatactcaacagtgataaaactaaaagcttaccttctaagatcagaaacaagatagggatactcactgtcaccagttctattcaacatagtcctggaagtcctcacaggagcaagtaggcaagaaatagaaacaaaagggatccaaaacaggaagaagtaaaatgtcccggtttgtagacaaaatgatctcacatatagaaaataactgaagaacccattaaaaactattagaattaataaatgaatttagtaaatttgtgggatacaaaatcaacaaacaaaaattagttatgtttctatacactaacactaactgatctaaaaaggaaatcaagaaaacaatccctttacaatagtaccaaaaagaataaaatacacagtcataaacttaactaagacagtgaaagacatgtattctgaaaactacaaaacattgacgaagggaattttaaaagacacaaacagatagagatcttgtatagatggattggaagacttactattgttaaaacatccacattacccaaaattatctacagatttaatgcaatcagaatttcagtggcattttttacagaaataggaaactcagtggagcttcttccttctttttgactctcatgaccctgtcctcagcagattcacctgtgactatatctgtttctctttctgggtcttatctcttcttgtgcctctcatgtttaagtatctcccaatattcagttaataacattttctgttttctgtaggtagaaactgccatgcccacaggtcgagctatgacatgcatactgatgcctcccagaagtaccacttcaatctctgacctccctcctgagcatccagatttgaatttgcatctttctgtgagcatctccaagtagatgtccttcaggcactattcataggttgaaaagagtgcagagcagaaagatgaataaaagcacaaatgctggggtcaaatctctgagattcaaatcctggctctgccactaaatagctatatgtctttaagccacctaattaacctctctgtgcctaaggattctcatcagtaagatggggataaaaatacttgccttataaaattattgaaatggttatgctaaaaaaaatgtgcaaagtctttagaacagtgcccggcacatgttaagtactgtttagctatcagccataattttaaaaatagtgtttttaaaatcagtaatattattgacaaccttttctgaatattgtccaagtgctttacagggattatttcacttatcatgggaatgatcctatgagatagccactgttattattcctactttacagatgaggaaaagagaggttaattagcccaaggacacacagtttccccaagatcaaagagtcagtggtggggccataatttaaaccagggcagtctgacttcagatccacacttttgacctgggcttccctgctcaattacaaataccaaattgactccttatcttctccccagaacagcctccctttccggttttctcccctttccccaagattaccattacagcccctttctttttcacctgtgaattagcaaatgctgcacccagaatctttcctccacctctaccccattctcttcttgctgccctgactagttgaactgtcctctttatcttaacctgtcgtgacaccacctccctggtcaccgtgctcttgccttcttgccttcttgcctttccaatttatcctgctcactgacacctcagttgccatttggaaacgaaaatagaattttcagcttgataacattaaggcagagatgttgcagcaaacaaacacttcagcaggcaagacaaatatgtttcagatattttttagcagctagagaaactccaaagcaacagccagtgatttagaacagaggctcctcttacgaagcagacaggctgtagagatagaattcaaggctcagcagacatgtatctcctgttatataagcaatcagaattctcttttccaattgaacaaatccctctctgctttgatggggaaactgggatgtcagtttccctaaaatgaaaattctatttcacagcaaaatggttccagtcaactggagagagagagaaagagaaatcataactgttttcccctccccagcctagcatcctccccacccccttaacatggaaaactcctatacatcctttaaagcccagggaaaatgtgtcttttctgttgaagccctttgtcaactcttccagacactttctcctttttaatcatgcagtagaacatggcagttaggaaaatgggctctttggaaaatattcagtgttcaaatgctgattttgctattcattagctacatggctgtcagcaagttgcctcgtcttactgtgctacacttttcctcatttgaaaaatggagggcggtctcacctctctttttatatgtgattatttggaggattaaaagggaaaaattatgaaaagcatttagctcagcagctggcacttgtcagtacccagtaactgttaccagctgaattttatagccataaaataaatacaagcatcctagaaaattataatacccataggaagcatgagattttttttccaaattaagaaaaaagatatagtagtcttggagtagtttctcttcctcttaaaggaaaaataaaatgtcagactttcttacattctcataggtcagtaggttgttcctatagctatggggacaatatagtgagggtatgaggcagacttcaagttacaagttagggtttgatccgatgtcttggacatttgcttggatctgtacaaaccaggattctgtccaagaactcctttgatgaggaagtgttgctagaacttggcctatgagctctgcctgctgggaattagttttagcaaagagagagagagagagacagagaatatcatggtgatgagtgctaggacattgtcaaggctcttttaagtgtgaccaccaggggacagcaggaaagacaggagaagacctagagttcaacttggagtactgaaagccttccctttccttcttttctctctgtgaaggttgttttccttctttggggagttgcaggcccatttggtaaatgaagtgtcatatggagaattttcagcagatgcttctcttctgatagggaatggcaaagccccctaaattcatgaaacatatgcaggtgccagccaactttgcactgccttcatgacacctcatctgttttctcaaacagccaagcagcactctgtgcccttagtgaagtaagggggaataggggccaaaagggcagcgtgaagacctaactgttgtcctccctgacagctgtcgttttgtgatgctgctgcttgcttttcatgaaatctgtgaccagctccatccctatcgtgccccctgcctctgtaaccagatttttgagtctacatataggtttactgagatgacatttacttattcattgattctgtctttggaagatgcctcttccacccatacaaggtatgctgaataattggtactcagaagtgtaattagccacacatataagacatcagaactactatatgggaggcccaatgactgatcatgaatatacacagtgagagaaatgtcagtcttgtgtgaattatcttatttaaacccctcagccaccaataagttaccttctacttttacatccttagatcaggagtaagattccaagttctataatgatagccaaccaagacattacagaacaattgccatgctctaccagtagtaatacctgacatttattgagccaataatatctagaccatggctgtagcatatttcctacatagaggggaatttactcaacaccattcttgatcagctgcccaaaccccgcagtattatataaagtgacttccctgacaagttgccccaaggcattcccataagtgtactggcattgtggttatatactatgaaatatatattataaaatgcatttttctctgctcatgttttccagcaggtttaggagtcacctaaaattattgaacatcttgcttccaaacaaaataaactgtattacacattcagctctacataataacaggaatttcttttctctgaatcgtccaatctttttttttttttaaaaaaaagttttgtatgtatgtgtgttctgaatactatatgcatagattttagcttgagagaactgattaactcacattgcatcttgggaggcagattagctaggcatcagttttaaagaattagatttaaatagagggcaaagaatttcccagaaaagatgagcagaataaaaaatataaaagagaaattctcaagatcaggacatagagctaggttccatagatgctacaaattgaaatgaaccttgatcctactctcaaggaactaaatcgagctgtcacaatctctatgaagcaattgtagaggtaattaaaaatatgactgaggtagtcacaattgagagcatcaactaaggtcagtgaaaattggagcaggaggtctggctagacacaaatttgggagattcgaagcagttgaattctcaagcagcgttcagacacagagattaatgctggtcaaaggaaaaattgttcagtaccaaggacagctccctagaaagcttttattcccatagatctctgggcagagaccacaggagtattttggtagctgtgctctctctcgtaatagttcattgcacaagcattctcatgtgataatgtgtgcacatgacagcatcttttacgtaccgattaaattaccagtggtaccattatcattgtattacggttctgcagagggacagagctaataggatatgtgtatatataaaaggatatttatcagagataattcacccacgtgattacaaggtaaagtcccactataggccatctgcaagctggggaacagagaagtccatagtggctcagtccgaatccgagagccccaaaactagggaaaccaacaatgcaaccttcagtctgtggccaaaggcccgagagctcctggcaagtcactggtgaaagtcccagagtccaaaggctgaagaatgtgaagtctgatgttcaagggcaagaggaacaggaggaagcatctagcaggggaaaaagaagtaagacggaagacccagcaagcaaggttatcacaccttcttctgcctgctttgttctagccatgccgacagccagctggatggtgtccacccacaatgagggtgggtctttctctccctgtccacagtaaaagctgtgtaagtggataagattaataagggataatgtgaagggagatgagaacaagggctacatctagaacctaggaggaacactcatattccagtactggaggagaaagtggcataagtctagaacccttccagagaaggagaaaactctcaggaaagtataggattagtgaggtgaagagaagaataaatatccagaagagggttaattgtttaagctatattaagctgcaaataaatgaattccagtactagattaaacaataaataaatgtaattaattcatataaagtgattgaaggtaggcagttaagagtgtttcagcagtgtttcagcagctcatcataatattatgaatcttagctctctacatctttccaattaattatcctctgcatgttgacttcttgtccctgtgtttattgcctgatggttgcaagacggctgatgcaactctagacacatcaagatcatgttgaaatgaaatgagatgagagtgggcaatggagagaagattcatgatcttttcttccatcaggaaagaaaatcctttccagaagttcctatagacttcttatgatttttaattattcaggaccagattacatggccacccctactgttgaggagactaatgaagtatttggcttttccaggctttgttgttagcgtccagtaaggatgcaattggaaatggactttgtggtgaacagccaacaagattggccacagtggaattaacgacatcagtgttctttcagacattgaaatgctttttccataattagttcttttgaataagctgataaaatagtcaagattacccaaagcaccttctcatgaaagcaggaaacaaagttttggcaatccttagccatgatattttggttgctaaaattgatggcatttcttactttttaaaaaactgtcatatgaacaagtgtttagttcatctttttctcatatgaaagttaagttctgacttattcatgttggtctcagtttttaagaatcaatcatacagaaaagttggtagattttgtggatttatagtagaactacttagctaaaaatttgtttatcatttgaaggccatgttcccctttaattagatattctagaacctctggatttttccataatactatttttcgtaagttgtactgtataaaaataattcgttttgaagatgttgtatcattgaactaaaaatcatattaatactcatccaaagaattacacagtcattctctttaataggggaacttaagaaccagaactgtttcctatgatgtttaggagacattcagtgaattttgatcatgatgaactagaacatccaattctaagttggacactggtctcagaaagaatgctggctgcagaggtctttgagataatgaatcatctggtttcttatagtattaatgcttataattagagacagaaaagagtttaatttcttgcacgaattaattaatacttacgataaatgtcttgaaagctctttctggtgtctggttcaaaaattgcagttcttgaggtctgttaattccttctaaaatggaaaagctggtaaaggttgtgacactgctgctaaagtgatctgtgaattagaggacgtttgacttctcctctgacctctaagctcatgtggccatttgcttgcatgacctctcattgagattacccaaagttgccccaactttaaaaggaagataataacagtactttcctcatgagcctgttttgataattacataagatgcttagaaaagtgcctgggacacaatgaacactcagaaatgttgggtaggaacaatggttatgatgatcatgataaaggaggaggaggagaatttggcaattatttcctgagtacccactatatgtaaaacactatgccaaatactaggaatacaaaggtaaattagacatgcaagatttacgttccagaaagcttcatttttgtgttctctaattctgtacatgtctttcttccatttataatgtagatttacatgtaacagcaaactcactggaaatgtgtttccccccattttctgctatattgaccctgtatgtagaaataaccagggtcccacaaaaatctgttttgttttctttattgatgagcacagtttaagaattgtgtaagtcctcagtagcctctaaagtatttcaggcattttcaacatgacatgtcaacactcacccaagagaccatcttttaactaagtcgttattgaaagttctcattttgttcacttcttcagaaaattcaaagaagaaaaaaagcctaaagccactcactcgttgctctttcaatggcatcaccattgtgtgatctgtcttcttctgctagaaggaaattccaggaatccttgatctcgcatcttttaaactgatttcacagagggtatccctgacagcatttaaaaaaaaaaagcaagcaagaaaaacctcaaatgggtagaatttttctaaaagtctgaaataaaagtttataactgattttcaggtttcctattattacctaggcacacctaaatgaatacttgaagaatggggttgtaaatactcccagaggcaactgcagcaatcatgatcatatgtctgttgcagtggaattctttagtataaattattgtatattaaaccctaataaatatgtaggatcaaaacatgtgtttctggttgtggggactgcaagatgtgcaagtccccttgtccctgttctggtggcccttgagcattcctgccaatctttggaacttcagagaatgccagagttgtggggaaagataattcttactttctacccccatttccctccgtcctatggcagtctgggacgtggctgtacactataactaaactttaagacatctacaagtaagaaacgtgaataagaacttcacctgggaaaccagtctagaagagggaaatccaacatggactgaacagtctagaagagggaaatccaacacgtactgaacagtctagaagagggaaatccaacagggactgaaaagtctagaagagggaaatccaaaacgtactgaacagtctagaagagggaaatccaacatggactgaaaagtctagaagagggaaatctaacacgtactgaacagtctagaagggggaaatccaatgtggactgaacagtctagaagaggaaaatccaacatggactggacagtctagaagaggaaaatccaacatggactggacagtctagaagagggaaatccagcatggactgctgtgcaccagcctacatcatagtcacgtggttagcattggttgcatatctgcagtagcctagagtttaatcacacaagcagccttggagctttagttaatttcagttgttcaaactagttggatttatgaaggccttgccatgcccttcatcccccacttttgaagcctctcttgattattttttttaagctgctgtggtaagaggtaattctggatggaatattagttagactgaggcaaactaatataaataatattggactattaattttggaagggtcactaagccccctcaaaaataaaaaggaagaaattacacattttcataaatggttttgcaagaatgaaaaagtaatctttagtcctagacaaatgctcttggaacattattgtataatttctggttcttttctctctcgactgtagttatttcacacacattacagatgaagccactgtatcagtcagagaccaattttaatcccaaggttgattagacaggtagctcttcgcagcttgtgcactctccctttgttctacagccctacactcacacagacaaagatttacacacaagtaaggatttggcctgattcgttagtggaacatcctgatgaacacttggttgcatttaaccttttgctgcaacaaaaagtcccaaggttgccatagtaatgggaaattaaatccacagagctattccttttcccttagtggttctggcatgctatcacaccatagcatgcttacaacctcggtcaagaaagagctgtgatcccaccgtttgtccatcgagttctaagctatggtatttgtaaaaggtcattctgctctcccgacattaacctgaatggaacagctggaacgtaaattggaaggaggagtgatgattctccctttggccatttgatgacttgggaattaaatgggacccaatatgtcatctaacgttagttccagccagtgtttcagccacaggacatctcggaaaggtggtcatttggctcttgcctgaagcaatcgaggaaggagagcccagttctggaattagacaattattgttcttacccttgaaccagccacttacctgctgcgttcccactcttggccaggggccaattaatgaatgaaacaagctccctgcactcaggaggctcacagagaagatgatccagtttatgctaccgcatctccaccataactccccttttagctcattaactccctcaaaaatatccttctgctaattcctctcccttcccctctcttccactgttgcctttggagctttcactttatcctaaacttctttatgtctttagtcatctcctagaacacacatttcctcacctttagagaaacttgactctttcttcaactaatctgcagtgttcaaatatgaatacctttctgtctttccttctttctttctctttttctttcttcctttgtctctttcttcttcctcctttacttcctttctttttttctttctcccttccttccatttattcattcaacaattatttataagggacttaatatgtgcccagcactgttctaggcactacagatacagcattgaaccaccccaattaagcttgcattctactggggagaatgaaaataaaattaaaattaaaatgagatatatagtaaattaaattagaaatgcagtagggtttctttttaagtggaggtggtcctttctcctatcctcccaacttcttaactccaatgtttcaaagctaggaggagaaatcagtattcccagggaccctttggaagaacctttcttctttcaccctctttcatccattccttctctgaagctcatgccatctgattaatcacactatgttcactcctcccagcctctgggtttccaccctaatgcattgagattctagggctctggattctggttcagttttcctgtctcctttcagcatttgagtgatttctgcatccgatttgaagggtcagtttcttggttttcattattccaataatgtttctctccccctcatttgagaagccaactcataagactaaactctagtccttgctaatatgccaactactctaattccaatatttcccaccataaatctcctcctggaccataaccttttgtttctcccaattttctctctcatggaaacaactcccatggaaacaatcacacacacacacacacacacacacacacacacactcatgtggttacctttttgccagttttccagcctcctggactgaacagtctagaagagggatccaacatggactggaagaggggaatccaacatggactgctgtgcaccagcctacatcatagtctgcctacatggtgcttggcatgtagatagaatgagagatgctgaatgatagtcctcattctccctaagcccttagtgattatgagcccctcccacttgtcctaccaaacttaaacttcttattaacatgacccatctcttttctcctctcttgctgttaaggtgtgtggtgatcacagtaatggccccccaaatatgactttgtcctaattctcagaatctataaatatgtttctttcttttttttttttttttttttttttttttttttgaagacggagtctcgcttgctctgtcgcccaggctagagtgcagtggcgtgatctcggctcactgcaagctccgcctcccaggttcacgccattctcctgccttagcctcccaggtagctggtactacaggcgcccgccaccccgcctggctaatattttgtattttgggtagagacggggtttcaccgtggtctctatcttctgacctggtgatccgcctgcctcagcctcccaaagtgctgggattacaggtgtgagccaccgcgcccggcctaaatatgtttcttacatggtcaaagaaaccttctagatgtgattaagttaaggatcttgagatggagacagtgttattgactatctggatagacccaatagaatcagaagtgtccttacaagagggatagaggagggtcagagaaagagatgtggcaatggggacagcagttagagtgatgcagccctgagccaaggaatgtgggtagcctcaagaagctggaaaaggcaagaaacgaattctcttctggagcctcctgaaggtaccagccccactaacaccttgacctaacccccatgagactgatctccaacttctgacctctaaaactataaatcatcagagttgttttaagtcactaagatggtacagttagttactgcagctgcaagagactcatataaaataccagcaccactagataacacagcaagggagtgcagtgattatggtgccttgtgccttcaggattctcctccaccctcggcaggcctggtgctactaagcacctctgcacttatggtctgctgtcctgttccaccattctctttcccagcacatcaagaaccaaccacagagttgacaagaggccacttgtaacaatgtgagcttctgttcccctaatagtattaacaattacattcctgtgactcctttcagggccgtgaagatgttccttggacccaggcaaaggcagaactgctgacagctttggctgctccatgtcacctcacttgtgaatggcgacagaaaagccagggtgatctgtagctgatcctctggtcagttccactggctcaaattaaaattttagagaatcggtctctggtatatttcccctttgcagatgacacagagagggtcatttatgttcataagttggggcgaaagctccactggctagtagcagcatttgaatagggggaaatggcaccttttgactgctcatgtttattatgggaggggaaaaatgagttttattattgaacttcatgtgaccttccatgggatccaagagggattcaatgactgagaaacacaggaaaaacagcaggcagcaaaaacagtgaactagctcaagaaatatgtttttttgtttttaaaaacattggaaacatactacaagtccctaattagtttgacctccatggttagattttttttttttaactccaatattttcctgagttgattttagctttgtttgtttttccattgacaagattcatttttaattgtgttgtcaagttagagaataggattctgcttttgaaaaaagtgcttcgtggcatggagataacaataacttttcataacttgtgatgttttgttaaataacttcctgaacgagccatggtaataagtgctagcccaagaaatcagaactttggtgcttggcatgtagagaggatgagagatgctgaatgaatgagaaataagtagatatactagaaattagtccgtaagacaaggggatggatgagattctgtatcggtttgcgattctcttcttgcctttgttcctttggggaataagctacacatatttatttgttgatgttttatggaaaatctatttggtgcgtgaattctgttgttttcttgtgaagttcattgtttcaaatctccccatcttccagtgcattcaggcactattcttggtttatttgttaaaataactgttgcactgggccaatccattacatttatctttaataaccaactctaggggtttgttcggtcatcactttccctgtcaaggggcacaaatatcttctctcatccgtttcctagggggaagtatcttcttttcttgtcttgataagacagttaccaaaggaagaaagaggaaagccttatcctttgaaagatggcattaattcatgtgcatttggcagtgggagaggatattgcagtctggggtcagctatgacttaagactttctataagactggatctgaacaagccatagcatttacgagaaggtccttttgtgtgttgtgacacagactggtatcccatttatgacaagagtggcccattttctaagattggtccagagcaggacactctttgaccaatctcaaccacctgatttcctcatgaggtacaggggacttatgcaaacctctcctttaatatggaaacctctcctttgatgacccatctttaaggaaagggttagaaccttcagtctggattttattcattatcatgtcccctatgccaggctcagagacttcctgtgattatatttgttgcatgaccattacatatacactaaaagacaatgaagacacacacacacacacacacacactcacacagcattgaagatgacccaaaagagagaaaatgaagcttgagaaaaataaaaataaattacctggtctccagccaaacaacctactcagaatgctgaggggaaggtgaccagttgtggctaatctttccttagaacttgtgctctgcttctgtaacttggcaagcacaggcccttttgtaaaatacctttataatattccactatgacatgaaccacgtttttattttattttattgtggtaagaacacttaacatgagctctaccctcttaacaaatatttttgagtagacaatccattattgtgtacacaagctatctggagcttattcagcttgccaaaagctatctagagctaattcagcttgcctggctgaaaactgatgcccattgattattaattcctcatttcccctcccttcagcccctggcaaccaccattcccctctttgagtctataaattggactgttttaggtacctcatctaagttgatctggtacagacactatgggacacagtatggagtttcctcaaaaaattaaaaatagagctaccatgtgatccagcagtttcccttctgggtatttaaaagaattgatatcaggatcttgaggacgtattagggctcctgtgttcaccacagcagtactcacaactggcaagatgtggaaccagcctaagtgtttcctgacatgcactctcttttccagtttgattaatttacagtgatcatgtttgttgcatgaagattaactatacagtaaaagacaatggagaaatacacacacatactcccacacagcattgaagaggactccaaagacagaaaacagggcataaggaaaatgaataaatgaaaaacctgatttcttggcaaacaacctaattgatgggagctaaagtagttgactcttatttacttccactttattctttaacattacaaataatagactccctgaattgaaagcaaaattaaatgtgattttatcaaacctttattcttctttttgaaatcctgcttttctatgtcttatccatagaatttccaagtctctgcttgagcattttcagtggtaaagaatttacactctcatgaaagagatcatttcactgttggtaggttgaaattgtaagaaagttctttctcaacaaggatctgaaattattcctatagtttcacccagtagtcctgtctctacttaatggtagattccacattccagatttttaaaaaagtttattctgctttcttgtctactttaatctacacaccagttcttttttttttatactttaagttttagggtacatgtgcacattgtgcaggttagttacatatgtatgcatgtgccacactggtgtgctgcacccactaactcgtcatctagcattaggtatatctcccaatgccatccctcccccctccccccacctcacaacagtccccaaagtgtgatgttccccttcctgtgtccatgtgttctcattgttcaattcccacctatgagtgagagtatgcagtgtttggttttttgttcttgcgatagtttactgagaatgatgatttccagtttcatccatgtccctacaaaggacgtgaactcatcattttttatggctgcatagtattccatggtgtatatgtgccacattttcttaatccagtctatcattgttggacatttgggttggttccgagtctttgctattgtgaataatgccgcaataaacatacgtacacaccagttcttataattgttgcatagttggctgcgttgaggagacaaccataggttagagttcttttacgatcctggtcctatctccttatcatttatttcattcattcatccaagcaggagatgatggcagagaggaaacagagcagaagtcattgtgcaaatcatggaggtctttgtaggtcattgtatcagtccgttcttgcatggctataactaactacctgaggatgggtaatttataaaaaattttttaaaaaggcttaattgggtcacagttctgcaggctgtacaggaaacacaatgctggcatcttctggggaggcctcaggaagcttccaatcatgcacgaagagaaaggaggaatgaggtatctcacatggtgagagcaggagcaaaagagagcaagaggggaagtgccacacactttcaaacaaccaggtctcataagaactcactctcatgaggatagcaccaaggggatggcactaaaccattcgcaagaattcacccccatgatctaatcgcctcccgccaggccccacctccaacactggggattactattcactgtgagatttgggtggggtcacagatccaaaccatatccatcattacgtgaacttggaatttttgcagtgatacatacggccattggcagattttgagcagaggaaagagggattcatgttttaatggatccttctggccactttgttgagggatagactggagaaggaggaaggggagaaacagagaaaccaggtagaaggcttctgcaattacccagacccaaggggatagtgtcttggacttcagtggaggcagggttgctgttgagagtggtcagattgtggtatattgccagttgcacagctggaaatttcagattccctgtgacgtgggaatcttttatccacaaggttgtcatgcatttggaataagagaaatgaattaccaacatgagctgctgggacaccatggatccgttcgaggagtatcagtagctgcagtagctccttctagtgctgtgccaggcacagaactcataccatgtcatcctataatctaccccaatggtagttaatatacccctatcacagatgaggaaactgaggccaggctcagaagtaggcttcaagtggaatgtctagcaagtggcagagtggggacctatgcctacttccacgcttgagatgttcttctggggcatggagaacagtggcaaggatcccctcctctcctcaccacagctgctgtaaacagagtgggtgaaacgagcttcaagaaaagcttttagactgaacttgagaagagtgctggcctgggactggagccaccacgtgtcacttcactctgggtggagaaaggtgtagccggctctcaggctcatgcagatgtcatgagcttccccaaagggccccaagaaaattctagaaggcagagttggatggcacaggcagctgggtctctgagatgcatcttgcacacagcctcagagcatccctgatcaggaagtgcaaacaggttgctaggaatattttcctcgatttaaaaatcaccaccacaccataaatgtgtagtgttcaaagaaaacttgcatggtcctgtttgacataacatttatgtttcttcttcatggttagggttgataagaattactttcactttacaaaacagaagccatgggctaaggagtattacttatccatgctgttgcaggaggtctcctactgaactggggtagaactttccagctcccttggctctcttactgtgtcatgcttctggggaatgagaggcacagagaagccatcagcaggtgtttactgagcacctactatgtgccagatactagactagacagaccaagtccccgtcttcctggaacttactggtagagtgttgggaccagaaaggggttgccctgagttctcgtcctggctcttgtgtgaattagtccatgactatttgcttacccaacatctcatagcttcagtttcctcaactgtaaaatgagggaaataagagtgcctctgccttccccttgaggcttgttgagtagttccaatgagtcagcaaaaaatgagaaacacgaaaaagctttgtgacttctaattcagcatttatgtgaatgtgggctatcattcattactgggaaaatgcatgaccagcggataaaccacaatgaccccatgtaaagagcatcattgtttccttggtgcacctactaattttaccaaaggcagctggcctcactccctgtgactgcaagaagttttcatgttcatttttgtgagcttggggatgagggtggtttctcctattgactcaggagtgtaaccaccagaagattcattaccccagcaggaaagaaaggggagccctctcaagtccagttgtgtggacccggtgacaaatgtggcaaacaggctgatgtagattccttgaatgtaccattagctactgccatgtcacattacacttgtttatgcaagaaccgtgcagcagataagagtgtttaaatgcctttattacatggcatcatggtattggtagtagttggtaatgatttttttttcctcagtgcaaagcacactcttaatctaaaaatatgaattatgcttagtggctcgttggaaagtatttcctttgcgttgggggggaatcaatcttttctattacttatttttctttcctttctagcaaggttaatatgcagaacattatctgatggactttattttataaggtgagaggtttcccagaagtgcagtacaaggctcattactccagtgcagaataaattgtccaaagtaatttgaaggggcatcgttaatagcccagtcttctatgtacctaagctgaggtaccaccttgccgctcaggttattgagaattgtccagcatctcaacgaactctgctccagtttcaagatggaccccattagggccaggtcatggtacaacatgggagaatcatagggcttggaattttgagacctgcgttcttgtcctacctgctccatccactggctagatagccttggctctgaacctacttccccatttgtgtgacagagatgacatgcaagatgacttcctcaagggtcatattccctgttgcctctgaaatataaagcagtgtctatctctggcgtggtccagccctgccacctctcttcaccccatctcattccactctcccatgcccactgaagtgccaatgattcaagtccacatgctgaaaaatctaacctagagtccctcctccactccctccatctcaaactcaattaaaaaaagaaaaaacagatccatccagtgtgccacagtgagataccaatcagtaatcatgtacatagcccttcctcttatccctgtcttagagccaatccatgtcccagccctgccgatgtcacccctcaatatgtctgcaatctgttgttttgtctttggttcctctgctgtcgccctaaccaaggatatgccccaatttctctcttggactctttcaacagcctcatacctggcatacctgcacctatttaaaatatatatatatgtgtgtgcgtgtgtgtgtgtgtgtgtgtgtgtgtatgtgtatttaaaataaacccctattttatttatatatataatatataaatatattttatttatatataaaacataggggttttatttatataaataaataaatatatatatatatgtatatatatacacacacacatatatgaaggaacatagggtttggaattcagagagagatatcgagagagtttcgctcctgtttttctctcaggctgaagtgcaacggcacaatctcggcttactgcaacctccacctccccagttcaagtgattctcctgcctcagccacctgagtagctgggattgcaggagcctgctaccatgtccggctaattgtatttttagcagaaacggggtttcgccttgttggccaggcttgtctcaaactcctgacttcaggtgatcaacctgtctcagcctcccaaagggctgggattacaagagtgagccactatgcctggccccctatttgacatatttttaacggtgtaggcaaaatgatcttttttccaaacactgcaatcgtgtcatccccttcaaagccttctgtggctccccgttgccccaaagcaacatctaactctgatgtggtccagccctgctgcctctctgatgtggttcagccctgctgcctctcttcactctgtctcattccactctcccacgcccactgtagtccaccctggtctccctgaacgtgccacgtgctctctccctgatctcagggtctttgttcatactgttctctctgtctgagttgcttttccctgtacctcacatctaagtccagatgactgttgctcagcctccagcttcagctcagctgtctcttcctctgataaatctttgctgtgtccctaggagaggccaagccactctgttactccctctctccgtgttcactagagttgtccttctgcatttcctgctgtctctggttggctgtctgtctccctcattgtattgcagactccgctgtgtgaagagaggaattgtgtggctaacaccaggcctggtacatagtagccactcagtatggggaatgaatgtcttacttttttaattcttcaatttaaaaagctattgagagtttgtccatgatccccaaggatacatttgacaatgtctggagggttgtcatgactcagggatgctagtggcgtctcgcaggtcaaggccaggagtgccgcttcatatcctgtagtgcaaagggcagcacccgtcacaaagaatgatttggttccaaatgtcaccagtggcaaggtggagatgccctgctctagaaactgccaaagaagctgttgccaaataaaaactatagggaacaatgcaacaaatgactcttgatctaaattccatttcattggttgtttcattctggggcaatttcgctacatatgtttcttcatattggagcttataataatgcttatgtcatagtaattctgaaggagttgtcttttttaaaaaaacgtactctctctagaggctggagagggaggatcgcttgagcctgagagttcaaggctgaagtgagttatgacggtaccagtgcctcaagcctgggtgacagagtgagaccctgaatctaattaaaaaaaaaaaattatacaatgaataatgacccaagtactgtgttgtcttcatgccatggacaccttaatgctttcttcaaagcagtatgaggttgttaatctgagaatgaatctgttagccttccctgaactcataaagtttgcttcctctttgaaagaacttagtgccttttaatgcctatgcagccgtgatgtgccaagtaatatgttccatgtgtaatcccagttttctgatagtaaaaagaaaagttggaaacctttggccaactttggtgcctgtggctgggagaccttgcagaggttttcaaggtctgctgtgaatgtatgatttagaccacagctcagttgtgacatttaatccatagagataaatcatcacctgccattggtagggctctttatggataaacaggcctaaaatagttacctgtaaaactccatcagagtctccatcagaaatcaccaccatttttttttaatgtaggagactgggatggtgaaactctttcttgattttggtgcttgagaacaaattaaatcaaagtcaaaacaactaactttcccttggctgtccttgaggcatgcttggtactgttttgtttgggtttttttttcccagtagtaggctggagttcttatggatttgattctgacatcagcctcccaggagaggccatggtgtataatggttaaaagcacagagtccagaaggtgactctcatttatcagctgtgtgaccttgggtgagttacttgacctctctgtgtctcagtttccttctttgttagatcggataatgatagtccttacctcatagaaatattataaatatgaaatgaattaatatccataaagcgtttagaacagggaacgtactcagcttaataatgtacatattcgattaataagataaaggctggccgggtacggtggctcatgcctgtaatctcagcgctttgagaggtcgagtcaggtggatcacctgagatcaggagatcgagaccatcctggctaacacagtgaaaccccgtctctactacaaatacaaaaaattagctgggcgtagtgggacatgcctgtagtcccagctactcgggaggctgaggcaggagaatcacttgaacccaggaggcagaggttgcagtgagccaagatcatgccactgcactccagcctgggagacagagcaagatcctgttccaaaaaaattaaattaaaaaaaataaaggcttcacataatatgcagccaaagtcagaaaaaaaataacattcttgactgcccttttcccatgaaccccagatccacttgatataatatgccctgatgtataatagtttggccaaagggtagaaattaatgtggaattcaacttaggagaaaaagcaaataaagattatttgttccatgtcactccaagatggccagttatcgcccaactctcttccttctgcttcctcaagatctcttccatctgcttccctccatccatcctcctggccactcccatgtgcatgctcctatcctctctgcttcagccacccacccctcaccggtctccctactctcccctgtgctagagtggactctaaagcacacacctgatgatgccactgtcctgctcaaaacccctttcatgacttaagaagcagtgtgcatcgaaatcgcagaccctagattcctttatcaaactgcctacaggagagcctgagggacttgtctgcaaagctattctggagtcagatgaaactggaatatttggtctttggtattcaccatgctccatcaccccaactgcaggaatcatttgcagctcatggacattttggatcacagggtggaagggaactgaagctccccattgttgcctaaacctaatggcaccaggtgtatattgctgacttaccttcctgtaggttgatttaggaattgaagtatgttaaaggaatacatttgagatggcacagacaatagcacctagggcagggcccggtcacagttgtctcttcataacattctaagtcgaggtatgtttattcattgaccaactccctggagtctttatttctagtacagctgctaaattcagtcattcattagtcatgttttaaggacaatggataggagacattatttaaaaagcaataatacaaaataccaagagctattcagctcttttatactagagcctgtatatagtacgttctttcccacaaatccctgtttttaaatattttctccatttcacaattataatcccccaaatgacagaatggttgtctgacaatatttcttctgatgttgaacatattttgtacgtttgagactgtgccagaaagtctatgcagcagtgacattgaaagaacagaacaatctaaactgcagatattcacagagggctgaaaacctacaataactattgggaatgttaatcatttcaaatggaggaattattagaggcagcacatttatcatgcatatcctcatcactagcttagagcacctggcatagtttttaaaggaaagggagaaaaaaaagaaacactataataatgagaaaatatgcaagatttgaagtcaggaaaatgtgggtttaaactgcagcttcttccaatagctatgtgatcttggaaagttacttctccagtctgaacctccatttcttcaactttaaaatcagagtaataatagtaatacctatattctaatgttttattggaaagaacggtgtctggcacatagcaattaacccaagcaatttacatagcaattactcgtgaaaaagaagctattaatactatttattgttattttcccactgctgttgcccttcagccaaagagcaccaggaacacatccgtaattaagaagttgggttgattgctcattgcaatgggagagaatatactatagggaactatgggatgtcttagtaaaagtgtgttagaaaagacatataatttgggcttgcattattagctgctttggcggaagggtcacaaaactgaaccatttctctgaattggttgctattcggaagcatgggtagttctatgaccagtgctaaatctcatctttaggtaggacagcctagggtgaggctacagccgtaattggcaaagaagcagctattgttttagccaggaaaggcgatggcttcggcaatgttcaggtctgtctgtgttcatgcataattacggaatggccttctttatggtctgattgactgtggtcatagagtggccttatctgatgttggtattctctgaaatcatgtttgacaggagaacaccaacatctaattaatgtcccaggccagctcctggaggtcagtggctacttttcttttccccatcatatttattcatatatttagtgagtagagtactgtcaatccttggtgtcctttctctaacaaagtccaaattctatgtaaaaaattctatgtaggtcaacaaaacttagtaacttgggtgtcaaatgtaaagaagaaaagataggctcaaaggagagagtagggctgatgtggtagagggtggacccacggtgtctgtgcaggccagggtagggaggctggctttcattttaaatgacatctgaaaagtttgtcattttaaaaagtttgcttggtcccagtaaggatggagaatggcttgttggggatggagaaaaagggaaaggaggttcaaaaagtgaagtaaagcttttatcatttaaatgtggcagcattagatgtgggtcacagagttgtagacaggcttaggacacggaaaggagtttggttattcatctggcccagttgcctcctttacatgtaggaaaatcagcactgaccaggacagatgaagtggcttgtccacacccaaatatttagttagtgcagagtggagagctccaagtgggggccagagcccagaagactccttcagccttgtgcccccaacactgtggaatgggaactgaatcagtcgtggggaggaggggtctctgcaaacgtggcaggtcacagaagatggacagcaagggccaggcacggtggcttatgcctgtagtcccagagcttcaggaggccaaggcaggcagatctcttgagttgaggtcaggagttcgagaccagcctggccaacatggtgaaaccgtatctctactaaaaatacaaaaattaactgagcatagtggcgcacacccgtcgtcccagctactcaggaggctgcggcaggagaattgcttgaacctgggaggtggaggctacagtgagttgagactgagccaccgcactccagcctgggcagcagattgagacttcatctcaaaaaaaaaaaaaaaaaagcgggggagggagattaatcctggtgcccttctagaactaccacctggcctttcttaattgtccacttggagtgtttgccaagcgaagaaaagatgaacccatgactgtgacctacctggagggtagacattctggagagcttcccctccaacaatgtcccaaatctgtgttcatccctgaacacaaccactgcagttctaggaaaccaactttctaatatatttaaggatgcttgtcaagattttattatctgttctttcatcagagagatgtttacaacagcagaaaaatttaaaaataaaaatgaaatgttttgaataagaaaataattaaattatggcacagccagggtcagtagtcatctggtcgactgtggatggatcttccagagactcctctcgcctgtcatttgttggcactcaatctctacctgttgttcaatactttgagtaccactctggtaatgaaataataagagtgatggaatactgtatatccatttgaaagatgacaattcaattacttgggaaaaacacaatacatttacaattggcaaaatacaagctctagaacatcagcttaatctatatctatgttaaatgtatgtaaaacttatgttcctaccaaatattaacagtgactttccccgattggtagaattagggatggttttaattttcccaatttttggtcagtgatattttcttaatgtttaaaaaggaacattaacagtttttatgataaatgaggaaagtttctttacaacatttttttgcatgccattccttagagttgggcagcttttgcaagctgtgagaagcccagctcctgcttttcctgatacggtttatgactcacagctgccaccaagatgtcagttagctctgtgacagtgaaatgacttcatttccctgaacccggatagaaacggtgtctgggaagagagagagtacctggtggagccctatgagtaaatgtgatgatgattcagctctggaccctatactctactccaaaaggaaatgtttcagggcatcagagggcatgaattcatgaatgtgtatacgaggctttgttcaggatatttttaaatatagaagttcattgatacaacatccctatgaggtagggattattaagagggctttatctataaggaggctgggattgagagggtttgaatgatttggcccaggtcacaccataagagctgggagcgagatgacagagtcttttttgtccacaagcaaaatagccatgcctgtacttgcagtcggaccggaggaacacacaggccaactctgacgcaaagcatggttatcaccatgctcctccaatgccacctgcgtcttagctctgggtttattattcactgagtgccttaatgggcacctatcgtttattttccctgggcctcagttacctcatccgtaaaatgagacaagaaggtatttgaggtagatgaacttcaggatcccatcagccttgacgagtgcaggattctatgtgaatctagatgagatttatccaaggacctccacatcctgcctcccacctccatgagcagctattccaaagctaccagtctggtgattcagccaaagacccatcattaaagagcacaaagacatccttggccagtatctttctggatgctgatgcttttctcctgaattgcatgtcaccttggagaactcagtgatggatgagagagatccagctttgacctggaaaactttcacattgcaagttttttttttctttttctttatagatttatagtcaatacttcagcctttctatgacaagaagcttatatttttctggactagatgtaacaaacgactttccaagtgatcagtgacatcccaagttagggctgcattttgaaattgttctttagaatctctaacttcattgggaacagtgatatcagaatgttaccttaatactctgccagaaaggcatggagaagatgtaaaatgtttataaatgaacatccagtgatgtgcacttggtaatttcattcaaagatgtaaaggaagagatactataagggacatttctgttattttgtcaaatgctattatttactgaaaaataaaatttcaccctatatgcttgaccttcagggacttattttaagatcatatggcttttcctaaacagctgaattatttagtgagattgaactctcaaagactttaaaataaagcccaccaaaataccagccactctgcagtgctacagctgttcagacctcaatctgcatatttcatctcagcagactgaagtttgcaactgaaaaatcgctcagaaaatacttatcaccttccatgccaaacgcagaaaggaatttatttgaagctgagaatgtgatagggtgggtgacttactcccacagtgatgcttagaatggtggatggagttctagctgcgtttttgctgcttcacccctggggaggccacgcctctgagaaagaggctgggaggcccttccgcaacaggtgttcaggtatgagtgaaagaatctaaggagtgagcttggagcactgcacccacagacaggaccatcattaggagcacattctcagtgcgtgttgaatgttacgaaaaggtttgatttatacatttttgacctaaatagaatttaatcaaaatgtctagagaatttttacgggttactagcccctcactttttctgaagtactaaaagcagaatcaggaattcaagattatcatgttgagtataaagcactctagtcttcctaaaggaatcagtgtcagactgggctggtggttcacacctgtaatcccagcacttaggcaggctgaggcaggaggaccacttgagcctgggaatttgaggccagcctgggcaacagagtgcgaagtccctacgaaaaaaaaaaaaaaaaaaaaaaaaaaaaaaatatatatatatatatatatatatatatggagagaaagagagagcgagagcaagccaggcttggtggcatgtgcctgtagtcccagctactcaggaggctgaggtgggaggatcatttgagcccaggaggttgagactgcagtgagccaagactgcaccactgcactccagcctgggcaacagaggaaaccgtttctaaaaaaaaaaaaaaatcaatggtacctcctatagagtcaggtgatggtgttgattatgatgatgatggcaaagacggtggtgaaggtgatggcgatgatcatggtgatgatgatgggctgatgatgactgtgatgatcatcatggcaaagatgacaatagtgaggttgatgatggtgaagataccaatagcaacaatgaagatgtggctgctgatgtgacaaagatgatgatggtgatggtgatgatggcaacagtgatgacaatgatgatgatgataatgatgaccatagtaatgatgatgatgatgacgatgatggtagaggcttacattgattgaacccttgctaggtaacagatatgttaagcacttaagccctgagtgttcattatcttatttaatcttcagcaccatcacatgaagtacatgctgtgattttcccattttaaagatattgaaactgaagtttaaactcggtaaggaacttgctcaaggacaatacttcttaaattttgctatacattagaatcacctggaaagattttttaaaatcttgacccagaggttgagtaatgtgctcaagggcacccacctgatgagtggcagaaccaggctttacaacccagtcactgagcaccagaaccatgtcctctcttgtgaagagccagtcatagtgcccaaggaattttcagggccatcattgctcatgtccctccggtgatgctgtttttaataatagtaactggcgagctggagtataatgttttgggtagcatggcagatctttgtggggcagtgtgctgaaaccagcttaaatctctgactgccgagttaatttatttcattcataatattctgttcgaaatgaaaatattctcatggttggttttgcctgaaggtataaaattccccaaatcagcaaatcagcaaatcagcgctttcctctgatgaagggggagttcacggaagactccaaaaatggaccaaaatgcctctgttcccacgttgcaggtaggaaattaaagctcttaagaaaggatggcattgtttatccatattcagaaaccacagggctgggatttttttcaaatgaggccatgctagttaattaagactttgcctttcagggattatttatattcttaatttttgatatttttcatggcagtggagtctgaataaactcacaggtgtgacctccttccatgccagctactactctctcatttaatcctcatacaacactgacatttgagtaatagttttcccattttgcagctgaggaaactgaggctgcgagagtttataatttataaaagcttttataatttataaaagcttttataatttataaaaggttttataaattataaaaggtttgcatcattttcacctacccgaatcattcttctacaaaagaagaaaagttatttcagaaaagcttcctaagttttccctaaaatgaatttctggcctagaaaatcagatcctgctgtgttcacacttggcctcaatttcctcaggcttctgggtcattaaggaggagctttatcacctggctgcagggtggaggaagccaagattctggaccgatagcctcccacagctgcgttagtattccacaaaggcgcaaccagaagatagcaaggaactttcacacttggctttaatttctctctgcacattttgttagcgataaagaccatcatgttttttctttctccaccttttttgcttttagaattctgaatagatgttttcatcacgtggctaagtaaaactggaatagctgagatttccagaattcagttagaagatctgataagcatctaaaacttgtcctaaggtagggggagaagtgtttagcttggaaatataactcggagttcccagtcttcctcaagtaggtacttggggagatactgaagtaggaggaagatgattcctacaaaccacgccgaacaacagacagttcagagatctttgtgcctcttgactcaaaaaggcaactaaaagatttctaaagcattatccccatccctcccccatcaaacttttttattgggtatagaaaaacatgaggaaggtcaggtgctgtggctcaggtctgtaatcccagcactttgggaggctgaggtgggggggcagattacaggaggtcaggagttcaagaccagcatggccaacgtggtgaaaccccatctctacaaaaaatacagaaattttctaggcatggtggcatgtgcctgtaatcccagctatttaggaggctgaggcaagagaatcgcttgaacccagcaggcagaggttgcggtgagccgagatcatgccactgcactccagcctgggcgacagagtgagactgtctcaaaaaaaaaaaaaaaagaaagaaagaaaaaagaaaaaattagaaagtaccttcactagatttagaagtaagcccttaggcatagatggtcagctgagcctttttaaaaaaggaagttgcttaatgagatcggtttccaccactcagtgttagagttttgtgcctccagttttataaaataatgtaaattattcccagccgcagagaagaaaggacagaaaatgaaaattagcagggtacagaagtccattctgctgaacaatggaagaaaaaccacacagggatttggtaccattaaactctggggcaattttctgctcatttctccatctcctctctttctggtggtaatcaaaggaacgagctccagataggaaagtcttccctgtaattaatttaaacaagttcagtagactccaattatctagtctgctacaacatggagaaatgactgggaaaggaactcctgggcaactggaatgaattccatgatggctttattaaggagtacatgtaacaaatccaaagtctttaagcttatccttttggggggcttttaaaagttatgtctttataataaaataaaagctggggaccatgtttacctctatctcaagtgttaagctgaaccattgatttatttccttagagtgatgcattactgccacctaatggtcatgtacctgcattgaaggggttaagaagtaaggaaatgatttaaatagacttaccaccaccactggtcacccgtcttaaaaaaaaaaaaaaaaaaaaacaaaaaacaccttatagtaaccttttttttttttttttttttttttttttttggtttgtgctggatgcggtggctcacgcctgtaatcccagctctttgggagggcgaggcagatggatcacctgaggtcaggagttcgagaccagcctagtcaacatggtgaaaccccatctctactaaaaatacaaaaattagccgggcgtggtggtgggtgcttctaatcccagctactcaggaggccaaggcaggagatttgcttgaacctgggaggcagatgttgcagcgagctgagatcacgccactgcactccagcctgggctacaagagctagactccatcccaaaaaaacaaagaaaaaaaagtttgatggatgaagcagatgagttactgtggatcaggactgtggaaagcccgccagttagacaagggatgttgccctcacccaaagagcagataaacaccattggtgctgtttgagctgggcggggcagatgataccagatctttagcaagatgagtttcacacctgtgtacaggaagaagcgtgtgaaaacaggtcaagaggatcctgaaataaaccaagtgtgagagtatcaaggtgacaaaagggtaatggaggctggaatgtgaagttagagataatcatttttttaaattatattaaattatattttatattatatatattaaatattgatttattttttataatttataatgatttatattaaatatcgactgtttgccaggcaccatagttaaaatgagatagaccagttctctctctcaagaagctcccacatcaagtagcccttgatgtgattcactctgtggtctgcagaagttgccccacctctctggtccccagtctcctctgttacagggaaaaagattgctctgggagttttcagaagcccctttgactcccaataggaacttgcctggagcaggtacttccaagggaatgagaggaaaagcacagtgtttagctgagataggggtaaatatggtccccatcttttattttattatagagatataacttttaaatgatagctttgtgtaggtgatagtggagctgagtgagctaaagattttttttttaatctcatgatctgagtctagctatctggagtggagcaggaaatgtggtatcactgatatgtaaagaaatcagtaaggaggggctcatttgcagataaaagggaataaaaccagggcaggcatgcagacaccatcatggtagctagacatataaatgcagagatccaagataccaacttcagcttggagggagaaacaagatcaaaggaagagggttcagcagttctgtgcatgacactgggtcagatctcttccctagaacaagatgctcaatggctgtgtgccccagaacaaggtgctcagtgtctctgagcttcatgtcactgttgtgtaaaagcagcactatgataggggcctcttcatagagcagcattgagtatctttggtttaacatgagaagagtgactggccctgtaagcttcagcagatactaactagtatcattatagctcctcctcctcttcatgatgatttatagaattggtcaatttttccagggaaaagcagtagagatgagagtaagaggatgcattcattccatgcctgcaagacagcccagctggggaaggtgaacttcagtggtggggaggagtgaaaggaatagaaaatagagatttggggaggatagggtggactggttccacacctctgagacagcaaagactccaagaagtttctgagcaaaggtcacaggacttgatgatttggaggttactgatgactttcgaaagagcagccagtgaggaatacaggattcttcgtatggagacagattacagaaagaagtcaagtgaagcaacaatatgctcctagataccgaatttccacagcctggcaatcctcaacaaaagggagacctgggctagttttagactcgagaatagatcaagggcaatgtgtgtatgatcagcaggctgcagcttccatattaacctacgttttaaatgtcttacattcctctggacaaaataaatcagcccggatggaattcgttgccacaatgatctataatgatctatgatatgtcttctcatttataatgtcaagcccttggagataggaggccctcaatgtttctttgagacctgagatgagaggatgatcaatgaaagtaaacgaagaggatcatggtaaagatctcatggtaccaagaggaaaacaactgataaacagggctcatggaagtccctgtccgctgggcaaaggagaaacggctcccttacctgatcacacatcttcgtcatgtccttcagggccccagatcctgttctaatgcagagcaggaagatggtgactttttgaaatttctggaaatatcactcggtgaatcaaagcaaattaattctctcttttagtcactctgagcctggatttccagtccttggaatttcgcttctaccaacagttctttcagagtcatttatggttctaaatacacaggatgcagttcccacatcacctcccctcataacaccatgggatgaataatcatggtgaagacaaggatctgtggccaaatgatggtttcaagtccctgttctgcaacttgcctaatgtgtcatcttggacaaatcctttatcctcactgcaccttcgttttgtaaatagggacgttaacgctgggacgtactctgctggtttgttttgaagagaaaatgagctaatgcaagggagagggagctcagaccacagatttgtgcagagaaagtgccgaataagtgacggctgctgtttctgtttttattctgcgaggaactctaatagaagaaaaagagcatttgatgactgaatcaccggtcttcgctagcagggcagaggcagatagttcccccgccccgaccccgggcccagctgctcatcactggggttgcagagttcaatgccgacatcccaactctgacccagcacggtgcctactggggaaggcagatatggataaaccacagcagcgccctgtgattgattctttgccagacggtggagaaagtgcacattcccagatagctcctgcagggaggttgcatgatgcccacaaacccacctgtgaggcccataagcctggatgttctctcttagctgcttaggctctgcccctcaaaagcggaaatgttgagtgtggagtgcagcttgttctatgaatttgaagtacgtggtccctggggttggaccagcaacaagtgactcagtccctctgagactctgtttgctcctctgaaaaatgggtggtgttgtgggggacaattttctacctgatgagctcctcatgaggatctatgtaaagggtagtatctgattcattaccaggattttgtatgctttataggcatgccaaatacagctgtatcttactttattaaatcgaacggaaaaaaatgtgaaaatcaagttgtgtgttaaatttgataaagagggccaggggcggtggcttatgcctgtaatcccagcagtttgggaggccaaggcaggcagatcacgaggtcaggagatcgaggccatcctggctaacatagtgaaaccctgtctctactaaaaatataaaaaattagccaggcatggtggagggcgcctgtagtcccagctccttgggaagctgaggcaggagaatggcgtgaacccgggaggcggagcttgccgtgagccgagatggtgccactgcactccagcctgggagacagagcaagactctgtctcacagagaaaaaaaaattgataaagagagttcatgatgtaaaacagtagttctcagccttgtgtgtgcgtcggcatcccctggagggcttgtgaaaatccatatggctgagccgcacccccagagttaccaattccataggtctgggtagagtctgagaatctggatttttaataagcgcccccagtgatgctgctggtctggggaccacacttggagaaacaccttcttcaaggagtcacatgtttctgaagcaaaggagaatcatttgtctttgtattactctgttctcacgctgctaataaagacatacctgagactgggcaatttataaaggaaagaagtttaatgactcacagttccacatggctggggaggcctcacaatcatggcagaaggcgaaggaggagcaaagttacatcttacatggcagcaggcaagagaaagcatgtacagggaaactcccctttataaaaccatcagatctcatgagacttattccctatcatgagaacagcatggaaaatacctgcccccatgatttagttacctcccaccaggtcccatccacaacctgtggcaattgtgggagctacaattcaagatttgggtggggacacagccaaaccataccactctttttttcttttgtttttgtttttgcttttttgagacaggctcttccgctgtcatccaggctggagtacaggcactatcacaactcactgcagcctcaacttcctgggctcaagagattctcccacctcagcctcctaaatagctgggaccactggtatgcaccaccatgtgcagctaattttttacttttttgtagagacgaggtcccactatattacccaggctggtcttgaactcctggactcaagtgatcctcctatcttggcctcgcaaagtgctggcattacaggcatgtgccacacgatgcccagtccattttatttcgtactgaaatattcttcctcctattttttcttttcaaactgaacatctttatattcgaggttaatttaaaatggagccttcagtgcatctggtatgtgtgtgaattggacccagctcagggattttgctcttctgtttaatctttgcttttcctgtggacccatgagtgtcaggactgatatttctgatttttcctttgtgccaaattgagcctcatctgcccggtcagccctaatgtcacacgcactccccaccgcctgagattacaggacaggagatacatttcgattcaaagttctgaaaatatgattaatctcaagactggagagagaaaagttattggaaatattttcataaaaattaatgtttatagtcaaccttgtgacagtcggtagtatgtcagcaattcaggtaaggttgtgtttgtgttttcttgtgcagaggatttagctgcctataatcagtttcatgaaaccttgctcttacatgactcatttttttcatttattcactcatttgttcagcaagtgtttatattgattacttggtgccaagttctatactaggctgtgaaaacagagacaaatatagacatcctctgttcaggcaatgagagctttgtaataagtttcttgttttttaaggacaaaggcttttatgattttagcatcacgtggctcctcactttctcggttcgttttgtgtttggttgatgttttcgttgttgttttgcttggggatggtacttgtttcctgcccagcaattcttgtaagtaagtaataatatagaataaccagatttgttgggttcctgcaaagacaaacatgatatttaaagaagcttgcaattaaatagagaaaataaacatctaaaaatagatgtacaatgcagtgtgatgaggaacaagagaagtacctcggtgaaagaaataatgtatgtgtttgtgatgtctagagaagtattcgtggatgaagtgatactggaggtgggttttggaaggagaaatctctttctcatattattagtctcagtcagtttcccctccttttgttccaggaacaccagcatttcattagacttagacccactgtaagcaaagggcttaagcacaagtccctgggggagaaactcaactctgccatcttctagctgtgtgcctttggaaatcacttaatttttgagcctatatgatggaatactactcagccctaaaaaggaatgaattgatggcattcacagccacctggatgggattggagactattattccaagtgaagtaactggggaatggaaaaccaaacattgtgtgttctcatctgtgggaactaagcaatgaagatgcaaagacataaggattgtacaatggattttggggattcgggggaaagggtgggtagtgtatgagggataaaagactacaaattgagttcagtgtacactgctcaggtgatggatgcaccaaaatctcacaaattaccactaaagaacttgctcaggtaaccaaataccacctgttccccaaaaacctatggaaacaaaaaaattaaaaataaaatgaaaaacaacattgatcatgaaaaaaacatgaataacattacaccccacacaggattgttgaaagaaacaaaagaaaatattatttaaaaagcacttagcatcgtgtctgacatgttataagcacttaataaaatcatagttgccttagttattataattatcacaatgttgatgggtgtcctacaatacgaagtggacggagtcagggctggggaattgagtctatctgtggggtgtgcgtctgtttaatggtggggttctcagatccttgcatgtacaagggcattgtgaattggctgtatgtgggcaatgttctctgccgtactcccgaacttgtttaaaaaggaaactctttatccaccatgtatctccaccatgtatctgtgagagctgggactctgcagatcacttattggttcacagcctccccaaatcagcctgctctgttcaggggaccatatgtgcctgataatgaccctgcctttgtagtccatggtcaaaagcttgccatgagtctgtagtgccagctcaaatggcatcatgctgtgctcctgccttcccaagcagggtgtgcacgcaggcaccctctgaaggctaggttctagatatcctctcatctttatctttgcaactttatcctggcttctaaggggcatgggtgtttcactgtcactatctgtggaaaaattgattcagtctgcatgttccgtgaaacactaggagattctccaaaagaagcctcagttagcaactgcaagtatgcaaaacaggtatattaaggggtgatgactcacctcagaaaaggaacctctgtttatagaaaagattaaccagaagacgtctttaaattacatccatctctgggcatagcttgtgggtgtctgagaaaatgattgagaagtaaaatctgttttgtgtgcatgatacacattcccaaataagcccaaaagaaatcaaagtgacagtttgatttaccttttttaattcagaaaataccttttcaatattgacactagaaatcagccctaattattcccctctgactttgctactttgtctttccttctcatctgtgtccacttgcttcctattgcattatatattttactttgcatttaatgtatcataagcacatcccagattgctgtatggtccttatcattataatttttaatgactgtgtaatggtccatcaagtagctgagtctaatttatttggccattttcctatggttaaacatctaggccatcgattttctgccatttttagctgtagaaactgtgttttaagaaaccatatgtagaacctaaatatgttctattgattttttttttttgatatagagtcttgctattacacaggcaggattgcagtggcatgatctcagctcactgcaacctccacctcccgggttccagcaattctcttgcctcagcctcctgagtagctgggattacaggcccctgccaccacacctggctaagttttgtatttttttagtagagaatggggtttcaccatgttgaccaggctggtctcgaactcctgacctcaagtgatccacccgcctcagcctcccaaagtgctgagattacaggcatgagtcaccatgcccagctctctattgattatttgtgaatacttcagcttatttaattttcaaagtaatctttaaaatcggagccattgttatcacactttctaagtgaaaattgatgctcagagagattgtagagtttgctcaagtctggatacctagcaggttatagacctgagacatgaacccacgtatctctgactttcagagggtggatttttcatcagtgaacaatacaacttggaccatgtggagtgagacaaggaaactggcaaggcccaagagattcactaaccccctctaaacctgcccctgatgaatggcagatggacattcaaccaatgacagctgtttctgagcatctaaaatgcagggagcctggtgtgatcactggcccacctgaggctctgggggatgagtcgcaggttccatccattgctgccgtgtctctgtttggtttagaagtggctttctccaaggacgtgaatgttcattttagtgcaccttctggattttctcctcttccctagatatttgcttttgtgtattcccacgcaggagcttcagccattgctacacgtggctccttcttgtgctcttctctgcttccagctgcgttttcctcaaaggctttctggtatccgtcaatccctagatctctaagaaccttgagctttgcaatttatccctcttcagaatcctatatgtcagtggcattggcggagtgggtggacacctggacaactgttcctgctttccattcgttttcctttgtcacttaaagtgcagggccagggcagcatctcttctgttagtggcgcagctttccctgtggacaagtctccctttccttctctgtgctagctggaaacaaatcactaattaaatttcatctctcgcagctctggaaaaacgacagactagtgcttccaattaatttcatcaacagtgtggaataagaggcatgttgcatcctgtaaagacagcagggctgaggggaggaggctcccactgctgttaccctgctgtctgtcttcagcgaggctggagttctgagcctttctcacctgcgttccaatatccagccctggcttgcttagagggtgagaagactgcatttcttcatccaccaaacaccagtggggagtcacctgtgtgccaggcaccacgagcctcccactgttgatagaacagcaaacaaggcagacacattccctgctctggagatagtgccagacaaaaataaggatgtcgggatgtggcagttacaggtgtctctgaacatttcactaaatcgaatggaccagggccaacgacctagagacaggaaagggactggttgagcacagtgaggccccgtcttaggtaaagaggatacagaaatagatcaacatggtcccgggctttggaaaaatccaaactggtgagaaagttacctgaggggtcagttgcagtacaacgtgaaagacgtcatgacagtagaatgcacggggaaccctgggttcaggggaggggacttttgccctttgtgggttcagaggcaactgcaaggaagagcagatacttgagccattttcaagagtgtgccagatgggctaatggaaggaagggcatttcagacgctgagaagtccggggcaggctatgtttaggaagcagtgaatgatgtgttgcatcagaaagataccctagggggctgggcgcagggttcatgaccgtaatcccagcactttgggaggccaaggcgggcagatcacctgaggtcaggagttcgagaccagcctggccaatatggcaaaaccccgtctctactaaaaatacaaaaattagccaggcatggtggcacacacctgtaatcccagctactcaggaggctgaggcaggagagtcacttgaacctgggaggcggatgttgcagtgagctgagaagatgccactgcactccagcctgggtgacagagtaagactctgcctaaaataataaaaagaaagatcccctagggcatgtccctgatggagctgaaatgccaggtaagcaagaggcaggttactaggggtctgatatggcttgattttgactttgggcttcatctcagaggcgatggaggatggagtccaagccaaaacacctgggcaccggcccaagctctgccacgtccctggtatgaccttggcgagctccgcagttcctttaatcactgggggtaataagagcactgacaccttacggttgttttggggattagacccaagaatacacatgaaacactcagcacgtgcctgggctttaagcgtttgataaacattacctctaattgttacagcttagtagtgtctgtgttagtattgatcaccatggtgggcagccaggcagggtgggcactgaagggctttgaagtcagaaggacataggatctattctgccttgccatcactcattacatagccccagacacgtcacttacctcccttaccccctctgcttttcaattaaggattgtgtgtgtctgccacccagccccagcttcagcacatggatcctcaataaatcacagatgttgtcgttgtcatcatcatcatctacctctattatcctcaacaacaatgacatccacagtagcaataagcaggaggagcacctaaggcagactctgctttagagagatgagttcagggcttgaggctgaaagacagggaaccagcaggccaggccatgcaagccttgcagctaaaagacagggaaccagcaggccaggccgagccaagccaatagtcactgacccactccgcatccaagatccctgaggcaaaatctgaaaacacacatgttaggaaagacatttgtctctctcccagatttctgatttgacaggtcatggcaccctaaatttgcattttcaaaagctccccagggaattttgcttttccagcaggcgtctgagaaccctcatcggacatacgcagtgatgctggtaaagcctgagcagaaacaaaagagggtcccgggggcagaatgggaggcagctctgggtctcttaagatggccctggtgtgctaagtgcaccagaggtaggaactcacccactgtcgccattacagacagaacgctcctaacagagagcttccaagaaaccccagggctttcctcgtctgctgggacgtctctgtcttcctgtgcctgctcctgctggatccaggatcccaggctggctccaactcaagatctgctgtttctcctgtacttgacacctggttctttgggctgttcctttgttgatctgttattgtttactttttagtcgcctttgaattaccaaactaagtcattcttgtagcaaaatctcaagcacagaaatgactacattaaaatgagccttccacctctcctaattcctccccaacacttcccaacatcatcgccattaacaactgtgtgtagtcctcttatattttcctttccttaaatataactacatatctacagacaggtctttgttttgatatgattttacaaacctatggagttatagaatggagttcatcttataactcatctccccccactacaaaaaatcttgtggtcatctttccatgacaatacaaattcttactattttttcatagctatggtagccttgtaacttatttactgatttccctttttcagccatcttcctgttgttttgcaaacccaggccacccagcaacaatcttctttatatactgtcttttcatactgacacttctcagtcctgttggatgaattcccaatggtgcgattgctcatttctgacattctgtctgctgatcgtgggccacagcaccggttgtctctttctctgactcaacccaagtctgatgagatttcagtttcactgcagcattgcagcaatgagaaaacatcccatcatgcactgcttctagatattgtcaagagaagggtatattattatgcaaaagcagtgtctatttacagatgatgaaacgacaatttttcatggggtttttctttttatttaacatcttaactgtcaattccaacaaacacacttgttttcctctatgactaatctaagaaccaagatggccaacagcacaataccaactttttgtttgtttggtttttaaatatggcaaaattatatatgagcttcccattttacaggtttctaagaacatcttaatgaaaataacagaactcagaaaatccactgtcattttgtccagaaatattttgttagcattgggatgcagcaatgccattgacaagaaacccatgtggaccaccttttaatgcttaatgagcctttcttcctagcatgcattccagtgggagagaggacagaataaacgtgattaaattatcggacagaaacacatgactataaataattgactctcccatgtttcatgagccttaacctcacacttcagaatgtttatttcctttatttcaaaatgtttgtttacttttctccatggactttaattaattttgcctttggcttataaacgggtgaaactaaaaacttttttatttgcatttttatcttgaagcaagctaactaattaaactttgcaatttggtttcactgtgctgtaccagagccataggaaaatggctgacagattcgcagatttgtgaccgtttttctaatgaaggagattttggaaattttgatggtttcatgtaaatgctaaaggtaaaacctgtattaagagtcacttgatcacaggaagaaaaataaccaaatgactcaactgcataaggaggtgaaaggaaggatctagaaactacataccagtaaacgtcccctgagtaccacaaaaagtgtagaatggagtatgagcattgtagttttcaatagtgttactcaactggtagaaaagaggaatgcccaaggcataattcacatagatttcagtctgatatgcaacaggttcttccatgagatgtgagggcttaaaagaaaaggtagagattgaagacgttatcttttaaaagatactcacagcacatttaattgataggggatcagtaacaagattatataaagaacttctaaactcaataagatagcaaaaaaaagtaaaaaataactaagagataaaaacagtcatttcacagaataagaaaaatgactaatgtataaaaaactgttcacactcattggccattgctaaaattccagtaacaattagatgtatttatataattttatgtcttcctgattggtaaatattaagcctagaaatgccaagctttggcaataacaggaaaacagagaccctcgctgactgctgttcagagagtaaatttgtacaacaactttgaagaacagtttgtcattatctaccaaagtggaagatgtgtaacctatccctaagataatctctgcaaggaattctcatttatgcccctgggcacagagacaagaacactcctagaagcatttctagcaatagcaaaataggaaatggcctacatgctcattgatggaagcatagctccgtacccggcagtgtgtacgtctgatgaactgcagcaaggatggtggatctccaggacatgcatatgtggaaaacacagtctgcagaaaaatacaaacagatgatttcatttatatagagttcaaaaaaacaggaaaaactattaggtttagaaacagataagaagtaaaactatgaagcaaaacaatgaataatagatttaaaattgcagatagcctgagtgcagtggcttgcacctgtaaacccagcattttgggaggccgaggcgggaggattgctttagcctaggattttgtccaagatcagcctgggcaacatagcgagatgttgtctctacaaataattaaaaaaaaaaaaaaagttgggcatggcggcccatgcctatggtcctagctgcttgggatgcttaagcctgggcagtcgaggttgctgtgatcactccactgcactccagcctgggtgacagaattagaccttgtctcaaaacacacacacacgcacacacacacacacacacacacacagaacaaacactgcagatagccattttcctaagaggaaaggtagcaggctaagatcatggaggaacacacaggagctgcagtggtatcgtaatgtgatatttcttaagctgggtggtggatacaagtgttgactgtactatttattataccttgctatatgttgtatatgcatgtgtgtatataggtacatatacacatacatgtatatgtacatattcctatttatatataaaatatatagcttttaatggaaaagaggaagtatcagctatgtaacatttatcaggcatgaatcttatctcattcaacatttttatcaataatttattaaaatctggctcatccagagcaggtgagggatgatgatgattgaatcaggttttctgaaaggcatggacaagctccagccatgaactgattatttaatggaacagaggtgaagatgaaatcttccccttgagattcttaaaaaccagttcactaaattgaggtgagacccccgcctttgttaaacagcaattcatgcacaaacaatattggggtcttagttgacaagttcaaaaggagccttctgtacaagtgtctgcccagagagctaatttccactctaggaagagtgatcatcctgcaacagctagcatgcatcaaggtgtatcttgtatagttttctcccagcatcttgatttgaatagagagttgacaaatcaaagcatggtcagagggtggtaactagcaatgtaaaagatcagcttgtaagtttgtagctcatcggaggggaatgtataagagctatagtggaacttcgaggtttccagaagatcgattctggctctgtgtacccaagatctcaccaaagccaaacataccccagaaagcagtggcctgccttgtaaggtatgagctcaggtccctggatgtgtttaggcaaaggctgtacacctccctgtccctacatgtgtgctgaaaggtgggctccatggctccaacatcccttccacttcgtggctctcatgagtctataagagtaacccaagagaagtcaccagcagaaacttggaaatcgttttaacaggggccaagagggaaacatggggcagtgcatgactgacagctgtgctctgtcacttctacatctgccttgcagttcttcaagcagccatgagcccctgcaggcaaacctgtggtctgttcagcaggacctgtctctgctgccttagcccctgggaaagggaagcaatgctgtggctccattttcagcagcgggcaaggaaaagaacttgggttcgagagtttcacaacttgagattgaatctccttctgcctcctttcagttatatagtctcaagtgcttatcttcctttctctgaatttcagtttctagctctttaaacaagggtcagggacagcttactattgcagaaggtggtgagatcaagaaagaaattagaggcaaggtgcagtggcttacgcctgtaatcccagcactttgggaggccaacgcgagcaggagtttgaggtcaggagtttgagaccagcctggccaacatggtgaaaccccatctctattaaaaatacaaaaaaaataaattagccaggtgtgatggcccatgcctgcaacttgctactcaggaggctgaggcagcagaatcacttgaacctggaaggtggaggttgcagtaagtcaagatcatgccactgcactccagcctgggtgacagagtgagattctgcctcagataaaaagaaagaaattggagcacctggtatatattgctttctcaatgcccaaccctgaaacatctctaatactatttgttcacttactcatcaatttgtccaataaaagtttatgtaatacctagatcctaggtacctggtggcctctgagccattgggaatatgcttgtggaaatacaccctcctctcgaggaagctatggtcttgtagctgagactgatcacccaacagacaatggtaaacccagtgtgccaagctctaggcagaggataaaaccacgaagacaagcagaatggaagaggaggaaaatataacactgcctcgggaaggagtgttggggcagactttctagtgtaatgaaagatgagcagaaattatttgagatgaagcaggaacaacctggggcaggggcattgaagattctattgctgaatgaacagcagggaccaaggcccaggcgtcagatagcacagccagctggtgaaagttcaagttaagtgcatcagccaggatgggccagcttatgctgtcatagtaaagtacccaaaatgcagcgattcacaataaaaacagttcatttcttcccattatctctatcctccagggactggctgggggctcggctccatgtcaccctctctctggcattcaggctgacagagtggccactttgcagaacagcggcagtggttgtgcagaggaagatggcataccacactacacacaggctcttgaagctttcacatgaaagtggcatgcaggccaggtgcaatggctcctgcttgtaatcccagcgctttggcaggccacagcaggaggttcacttgagcttaagagttcaagaccagtctgggcaacatagtgagacccccatcattataaaaattttaaaaatttaaccgggcatggtggtgcacacctgtggtcctagaaacttgggaggggctgaggtgggaggaccacttgagcccaggaggtcagggctgcagtgagctatgatcacatctctgcattccggcctaggtaactgagtgagactctgtctccaaaaaaagcaaagaaagtggcttggagcacttcggattctgtttcataggccaggtaagtcacagggccactcgtaaatccaacaggggaagacagtgcagtccttctgtgtggccagaaggagaactagaagtatcagttgacagcactaaggaccaccacttttgtagcaggagaagggggtcgtctggagtgggagagggtgagaaagaaacatcagccagattcggaagctcctttatgctatgttctagggggattttattgttttgttttgttttgttttgagacagagtcttgccttgttatctaggctggagtgcagtggtgtgatctcagctcactgcaacctctaccgtcctggttcaggcagtctcttgagtatctgggattacaggcacacaccactatgtccggctaaattttgctgggcatggtggctcacgcctgtaatcccagcactttgggaggccaaggtgggtggatcatgtgaagtcaggagttcaagaccagcctggccaacatggtgaaaccctgtctttactaaaaatacaaaatgagccgggcgtgatggcacatccctgtaatcccagctactaaggaggctgaagcaggagaatcgcttgaaccgaggaggtggaggttgcagtgagccaagatcgtgccattgcactccagcctgggcaacgagagtgaaactcagtctcaaataaataaataaattttgtagttttagtagagatgggatttcaccacattggccaggctggtcttgaactcctgacctcaggtgatccacccgccttgagctcccaacatgctgggattacagacatgagccaccacacctggccctcctcttattacaaggataccccaaggctggacggaatgcctgccctaatccaccataacctcattttaactaattacatccgaaaagacacattctgagattctgggtagacgtgaatttggggaggaccctagtcaacctagtacagaaagtgataatgtatttttgatggggtttcaccaagttgcccaggtgggtcttgaacgcctgacctcaagtgatctccctgcctcggcctcccaaagtactgagattacaggcatgagccactagattttttactgtatctagcaagggccattgcaggatatcaagtctgggaatgacacagtttctcatttcagaaccattgaattggatacagcctgagtagtattcattcattttttccacaagcatttgggtggtgacagaaggcggcagacaaagtccccccatcacatttggcaaagagggttgcggggattcattaatcaacgagctaaacaaatgaatttgtaatgtttcagatggtgataagttgcaagagtaaaaataaagatgggataacaggagctgacagcctgttagagaaagccagaagtgttaaggtgtgaggagcgaatgggctagacagctacaaaggcgacagaagcaacataactgagtgagcttctagaattacaagagggtccctgagataaaatctatagcaacgcctagggcaggaggctttgataaacatgatttgcatctgagtttggagttggaatagctcttttgaagcactctgtccccatggacatagatgtaacaccaaccctttccaggagagtgggtaacagacaagccactcagccggttttattaagatggaaattttcacaagggctaaaataaagattcaagtcaatggaagccgcctttttaattgataagagcagctcagcagtaaaggaaataggagatgcttgatgcctgtgtcgttctagtgttggggaattatatggaacactcaaagcagacctccccatcagctcagagacaattgatggtctgtgcatgtccttgtgaggctttctgtggggtaggatgagattagaagcaaagttgcctcttttactcttctggtttcattcttcactctggcagtcagcacaattcacaggtgtatcagccgaggaagcatctcacaaactctattctctcttacttccatgccattttggcaccgtgaacttgaaatcactggtggtgttctctttaccctgctggaatcacagacactgcaagttgaaagtcacccagaggcgatctgatgttttccttcctctacagggaggagaagtctcttctgcttttcacagcaggtgtcattcaacctacacacatgtgctgaaccacaggagcttgtggtctctcgaggcaggaccaccccccgcaaccccatggtcaagcagcccctgcagtagccttgttcttccccaagacccatcacccgtcctagctgggagccacgtgacgttacgctgtttccgtttaagcatgaagtcattcaaaagttggaaggtagcacgctcccattttagaactgttgtgccaaaccctattaacctcagtaaggaagacaccaggttcaagaggctgaagaagagacccagagccagcaaaggaggcatggggttttattaggggcttacatccaggcaagagagtctagcggcaataagctggacattagaaccgccttatatacagaaacagtccagcaacagagggctggataagatttcaccttcctatgatccactgtcagcaggctagatgacataagcacacagcctagtggcagtgggctggggaggaaaactgcaaacatcatgcaatttatataacattttcccttaacacactccccctaatgacctccacctggcaaccttcatcaacccaaaactcagggcctcaatgtgtacagctcatgtcccatggaatgaaacggagtggggggctcagatgtttatcatagacaaggaacaaatctcctggtcgacctctcctggattccctagtttggaacacacattcaggtgcatctgccatcctgggtcatcccaagggtatgcttaagtcactgttatcagatgcatttaccctacaggaacaccttcacatcatgttagcccaattcctttctttctttgtatcattgcttccctttaaatctaaaaagaagattaagtcttccatgccaagccaagcccaattactacaatcagtctttatatggcagtaccccaccatctagactgccgactaacttctctcctcctgatagtctctgctttatgtattttccttaaaaaccacaggaaccagctggatccaggactccagccacaatccaagggccagagtagagggttctaaaatttctccataaaatttacttctcgatacaagaaagcaatataagccataatggctgacattccagaaaaacactcttaccaagccccggctctcagtaaactcaaacgcatctctctgctcaaacgttttgtggttccaagagaaaacaaatacaccgtgcacatttttctttctttaaagattggaaagaaatgaagaaaagacttgtcttgtccatgtttttatagaaaaatataaagcatgtctcctctgtgacagatttcttttcctgtaaatccagcaagcccatgaaagagcttatgtgtgagcggatgtcacacattcatcttccccagccactttgctgcgtttctgaaaagataacatagatgcctggagtgcagacatcttgagatttaggagctggcgccttacagctctttgtgaattgagcctagaaaacgtgtctgtttttagctgaccccaagaacagaactggcaaccgcttcgtgcagaggagtcttcctccacggagttggttctcaagaaactgacgctgaaactttctttgggcacgagacacctgtgtgcttctcatatttggacccaatgctgttccttctgccctctgctgtctgtgtcgttcctggctgcagaacacagcccccaagcagagatgctgagtcctcaggacccaacccaccacacaccggctgtgtaaccctgagccagtcacttctgttctcccactaaccaaacaaggacaataatggagtcttcctggggtccgatgtgcacactggtactcagcacagtaccctgggcagcataaacagtccgtttgacagggtgaatcaaggctttctgtcatgaggctttctgtgaggtaggatgaggttagaagcaaagttgcctctttttctcctctggttccattcttcactctggcagtcagcacagttcacaggtgtatcagctgaggaagcatctcacaaactgtcttctctcttgcttccatgcccttttggcaccgtgaacttgaaatcactggcatgatgagatcaagtcctattccttggaccttgtccatgtgatctgatttggaagaagagtctttgcagttgtgatttattgaagggtctggggatgagagtactgtggattatccaggtgggccctgaatgccatcacaggtgttcttagaagaaagaggcaacaggagagaacacaggtgcacagaagcacaggcaaggtgaaggcagggcagagagagatgtggccgccagccaaagaatgtagatagctaccaaagctgcatatggtaaggaagagacctcccctagagtgtccagggagcacagccccgcccacaccttgacttctgacctgaagccttcagaactgtgagagaccaaatatccgaaatcctaagccacccagttcgtggtatttgttacagcatccccaggaaatagatttagtgagtgaagggtgagccatttgcattagcagaacacagaactgaggagacagaaacccagccacacttgtgtgaggcgtagggcaaatctttcctagataataactcaaatcattcagactgctgcctctctgcctctccctttctgtctcttttcaccgcctctccttcccttctttgttcttgatgaagttgagctgcctataaatcatcgtcctgtgtaaagtttttaaaattttattttaagttctgggatacgtgtgcagaatgtgcaggtttcttacataggtaaacgtgtgccatggtggtttgctgaacctatcaacccatcacctaggcattaagccctgcacgcattagcccagtgtaaactttgatctccctttggatgccagctgattctttcttccattgcccgtgggtttctgattgcccaccattgctaaagcgagttgtataggctgcaggaacaggtgcacaggactctacggctttccctggtatatcttttctctgctgaggtcagacttttagatggcaatactttttagttttgctgggccagatgtgtttccaggaggtggaattcagcagaagcagaaagttcaaggccgtggaagatagcagttcaagtggcagctgctaagggcttttcaactcagtgttttttcagcttgacttgcaaatagagcctgaaagttcccaactcttaaaaatgttcagtgtgtccagtcttatagcaggaggaagaatttgaagatggccagtgttgctgtttctcaggccctaatatttctttgtgctcagtgaacgggcaagttatcctgaggaagaaaatatttcagaggcttcagtgctaagtattaatcaaataggtcgggggtcgagcaggccttccacagtcattcatacaggaaaaacatattgaggctggccccaccctatatctcagcggggaataactaaagctattcaagagtcaccttacatccacggtgagccacatttcctgataccagatgctttcagggcaaccttgatcatgggtttttgtctattgcatcttcatgctgcaagaaaattctgtgtgtaagcatctctgtctcccagcaaaatgtggccagtggaaggtccacatgaggccttttcagtctggcatccacagcactagcacagggcctgccacaaaataggcccccataaagactggggttgaataaaatgcattgtttgcaacacgtaggcatgatttcttctttcctgcggtgggggatgggactgacccatcaaagcacatctcatatttgaaatgtatgagattcttggatagtgcaaaatacaatgtgtgcattacacactgaggaggctgctgcagtttctccaaacccctacaggctgggagacttttaagagacccttagacagtgtcacctttgtttatgcagttttcataaatttcttttacttggccgtagtctctgggtgatacttgttgtaacaggcaactattacagtacaagatatcctgcttcagatctgtgcagctctcctgggctcttagttggagtgaatcaaagcccctgcacacacatacacctgtgtgcacactctcgctttgacattcacctatccctctacttcccacctccagaaccctctgctgctggtgtttttctgtgtgtttgttttagatttttgctttttttagagaaaggtgtctcaccatgttgcccaggctagtctcgaactcctgagctcaaacaatccttccgcctcagtctcccaaactgctgggattacagatgtgagcactacacccagccaatctctgctgcttcttgctcatggcaccatccctttggctatcaaaaggtagctctcctggccatccctttgcataggccatagtggaagcttataatttgatcttggttttttcctttagctttgtcctttctgaaattcttcattttagcctagattcctcttataatagagcataacattccagcagtgctcaaggatgattcattgcctcaaagttgccacctctgaaagagtgtaatatgtccaccctactcattggcaggagggagaatctgattcttctaccccttctgctgctccaaatgataatagcagccaccacaaccacaggctcagcagataacacgcctagcccagagctgcacgtcctctgcctctcatttgcccaccacagatacccaataaaatagacaccgctagtatgagcttccttttgtggctgtgatgaattgctacatatttatggtttaaaatgtgcaaatttatctttttacacttgggtcagaagtccaaaatcggtctcattgggttaaagtcaaggtgtaggcaaggctggttccttccagaggctccaggggagaatccactttcttgatttttccagcttctcgggtcacctgcactccttggctcctgacgccttccttggtcttcaaagccagcagtgtggcgtctccagatatctttctttgacttctgcttccctgttcacatctccttctctgactcccatgtctctctcttacaaggaccttgttgggcccacccagataatctaggataagcccctcatctcaagatctttaatgacattgactaagtttcttttaccctgtaagataacatggtaagatattcacagttgttggggattaggatataggaatgtttgggaccattatttttctaaccaccctttttttttttttttttgagacgtagttttactctgtcacccaggctggagtgcagtggtatgatctcagctcactgcaacctccaccctccgggttcaaatgattctccttcctcagcctcctgagtagctaggactacaggtggctgccacagcgcccggctaattttttgtatttttagtacagatagggttttaccatcttggccaggctggtcttgaacttctgacctcgtgatccacccgcctcggcctcccaaagtgctgggattacaggcgtgagccacctcgcctggcctttctaaccacacttttatgcctgcctttgtaactgtgaagcgacttttgcagctcagagaggctgccccatgtgtccagcctccccagtgagtaaactgaaggcagggtttgaagtaggcaggatttgatcttggaacctgggctctaaaccactactacaccatatgctcacccgagcagtgcctaaatacccagcttcttagccaggctctcagcaacttgcaaggaagagtcatattttaattacctcttgagtctcatcgagcacatggaggagaccttgggatattgttgaggcttaatattgagttaaaatggtgattgtctcccttgtacaaatctacttctatttagacaacctaaggttactttggttttaaaaaatatcatttcacactaaccttgctttcattgaagacttctcttctgcttctttatcaaacgtggtgcttctgggccatgcctctcccgtcttttgataacaacaatattctcagagaacacagtgtcctgggctgaatgttacatgtagtcactcacttaatccatgcaccaaccccatcaggtgaaaaccattactgtccccacttagtaccgttatacctcaggctcactgttgtccagagtggagcagctgttcagtggcagagctgggactgaaactggggactctgtctcctgtgggcatgctgctaaccctctgagtattgtgagtctggatgggaggccagtggggatttatgttagacggtgccctgtggttgcaacaaatgaaaaccaacccagactttctttaacaaaggggaattgatgaatagatctctcccctaacaagaggctggagatatgagactggggagagcaggagccatgatgactctggagccctgaggtcggccccgggagctggcttgtagcagaggcagtggagtcagggcaccgccgctcaggggcgggactcacaaccccagatccgagggagcatctagtgcagctctcttaagttgtgtccattggcccttggggtgtggggagcaggtgcctttggtctctcttctgccaggttgtttctaagagaagaacattgcaatctggaaaagcagtattattgtagggtagaaatgaacacatggggaagagcatttaaaaccaaaaatgaaacagattattcatacagagtgtgccagaagctactggatcgaatctccttttgctccttaaatatttattgagcacctactgtgtggctggccctgtttcattcagaggatacgagggtgaatcaaatgtgcattgttaagttttatggatctaagttatcccttgagtggtggcctgatggcttggaagaggtaatacatctgtcagttctgacatccacggtggagagaaatgaatcctgccaaatggaaatgactctccagttccatgggggcacaggtggcctggaaaaagctaccccagtctgtgagcccagacagtccagaaggccccctcttagatctcaatcccagcgcatttaatttcagttttgtgtgaccctaatagagatccttcatcaagttttattcttcataaaagatccatttccatagactcataaagcaactccttctaattcagtgttattttatacatactttcattgctcgcatcaatcacaggcagccgacttcccagccatgaaacaacagcttgcaacatcaccatgttacccaatatgtatttacttatcaagttggagaacacatgtttgcaaaatcagcaacattacagctttactagcaatttgctagcactttcttcccgttgaacacggagtctgaattgtgtggtatttcactatcctggctcatttgtatcttgtaactgcagtagtcaccagcaccctgaaacctcctggagatccttgttgatcatacctggaacttcagccaggtcacttacctaacaggtgtggttctggagtcatcgatcatctgtcctgcactacaactcaaggatataggtcctatatgtccctcgggcttctggacctagcctaaagatgccccagacaagctgtaatgcagggcaaggtcctcaatagccactctgtagggagaattctggaaaattatcctacctgcaaaatgtaatgtgaaatatctgacatgagctgtgtggagctgagtagggaagttgggagaataaaccacacttcctgggtttgcctctcgtctcagccacttaccagctagataactgaggtgatgggcaagcggctttacctccctgggcctcagcttccctctccataaaatgggctaatgacacctgcctcatagggtttgtgggatgattaaatgcttgcaatgccctgagtcatctgctatggtacgaaccctcataaaggttagctccccatcactcctgcaccaacttttgtattcattcaggattatgcttttgtgtgtccctctgagcccatactcagccacttgccagtagtgatgatggagtggttatttgacttccctgagcctgagtctctttcttttaaaatagagatgatctaattaccctggcagggctattagaagaactatttctggtgcacagtccacacatgtatctcctcctccatggaattactgcaaaggtctcctcctcagtgccccctatattttacctgcatctttaagccaactttacacagtcataggtgtcagcccattttacagataaggaaattgagcctctgtaaggttgtgtatgttgctcagatcatgtagccagtaagtaaggtgccagagtctccatctgttcagcttctatcattccaaggattccactctcaaggccccacaccaggccagtagaataaaaatctctgggggagagtctcagacatcaagagaattttaaaatatcttcaatgagcagccagggttgcaaggcatacccccaggccatgtttgctcaacctcattctcatgtacggcccacatctggtgggtcccaccagaaaaaacaagagggtgggggaaatttagcagaagtatttcattaaaaaggaggatgtagcttagaattcagcaaattaaagcagaagccaaggaaatagcagttctctggtgtccaaagcaaggtcaagagctgggagcccgaggaataaactgtgaagccagcacagatctcccagaacagggaacccagagcttagggctggagaaggcactcccagagaaggtccaagcctagagcagtgactgtttgacttctgcccaggtacatcttgcttctcaccccatagggaaacaaccgctggaggagccaagtgttcagtgagccggtgcagttctggggccataatgatgaaaaggaaggcatgtgcattgttgcctgcgcagctgagtataggcactgaggccgagacactgagtgtccaggtgaccccctgtgtttcccaggccttccgccatctggctcctggctcttgaccacgactggctgcgtgatttgcagagcccattgtaaaatgaaaactcagggtcccttgttcaacaacaattaagaatgtcaagagggtgacaacagagcactaaacccagcacagggactgtctgagcaaggggttctgtgcaactgtgcaggtcacacgttcatgaagtccacctgctcttgagcttgccttagacaccaggtctggccgctgaagtgcaggcaagagtgctgtgtgtcgtttctgactgaagcgttcaatgagtcagcatgtgagtttgcaactctctgccgctcctgcagcagtcaggaagctgcatgttcaaggtggcctggctataagatgcaagggtctggatccctaagctgccacttggagagaggatctgccccttgaagtgaacccccaaagtggactgaatttgagtgagaaattaactttatgtgctaagccactgaaatgatagggttggactgttatctcattctagcctagcctaatatagtctatgtggtttttgttgttgttgttactgtttttgagacagggtctctctctgtcacccaggctggagtgcagtggtgtgatctcggctccctgcagccttcgcctctcgtgttcaagcagttctcacacctcagcctccccagtaactaggattacagggacatgccaccacgtttggctaaatttgtttgcatttttagtagagaaagggtttcaccatgttggccaggttggtcttggactcctgacctcgggtgatccacccacctcggcctcccaaagtgatgggattacaggcatgagccaccatgcctggcctatggtctgtgtttttaaagagcaaattgctgcgcctttgcccttaaatagatataaatgatagcgacaataagcccattgttcagaattaacccaggagttcattaatatttagtgtcagttaagtatcaattatttacctgcttcctactccagctttatattaccttaagctgtaaacgaagaaaaatgataaaaactcatcttttatttattcacttattcatgtatttattcacttgtgcatttggcaaatgtttactagactcttaatacatgcaaagcattattctggtgcctttgaacattttcatatttgtcagatatagagcagcatccttgatctctacccactagatgccaatatcacatctcctgccccagttgtaacaaccaaaagtatccccaggcattgccaaatgttccctagaggggctaaaatacccctcattgaaaaccactgctgtaaaaaggactaggcttgccatttaaaaatctcttaaattggctgggcgcagtggctcacacctgtaatcccagcactttgagaggccaaggtgggcagatcactcgaggtcgggagtttgagaccagcctggccaacatggtaaaaccatatctctactaaaaatacaaaaattagcaaggcgtggtggcgcatgcctgcaatccaagctacttggaaggctgaggcatgagaatcacttgaacctgggggacagaggttgctgtgagcccagattacgccactgcactccagcctgcactccagtgacaaagcgagactgtctcaaaaaaaactcttaaattggttaaacaaacaaaaaaaaccacaccgtgtccttttgttgtttttaagagtttatggaaaaatatattggagagttacaattacttcaggctaattcaatataaagagtatttttattattagtttggaatattaaagtttccacttaaaattgattttttgaagtgttttcaggcaacatcatttaattcagcatagagtatcctatgtctttcaaaaagaacttcatgggaatggtagataaaaagattaagtggaatttttaaggggtgtaagaaaaatcttactgtcgaagtctggataaaaggaagaaattaggacagtaaaatgaatcatgatgggggaccccagttttggccatgtgtcacctaatatgtcataaacagttcttcagcttcattaaagaatagcttaccagaaagaagggcagacactggaggctgaactgcagcgaatgaaaacctgaaataatcacaaggtggtcctgttgccatcatctctttatcagtataaaaataaacaacctttgaaaacagatggagacagtcattgctcaacttgtcataacttattacatatttggctgtcaatttgtacttaaaaaaccaactagctccagggaggcaaagcaaagtggagaggagaagcgaagcctgttgcatttcaattcaagcctgtggtaatttcagctgcatggagacacttaggactgtttttaaatgaagtcagcaactgtcccaaaatttaaggcattctcattttaaagagcacagttgtgttcctatgggatggcacttcctcacctcaaacctgtatcaggagtatatatatctcgtgcccgtttagtcagtgctgctctcccacagggtgagatctctctgagccagatcattctcggacagatgatgaatttttctgttccaaacagggaggtgggaggaggaagggcaaaatgtttcccatggatgtaccactttttaaagttgtaatctggagtactcatcaacaacatctaattcgtgcctttgggggaaagaatggctctaccaacagacaaggtcaaaagctggtgggcctcagaccgaagcttgccataacctcttttgtttggccttctagtcccactgagtgatcttttattttttaaatttgaactagtgtctaaaaatccaaattcccaccttttcttaaaaaatcaaaagatggctggacgcggtggctcatacctgtaatcccagcactttgggaggccgagtcgggtggatcacgaggtcaggagatcgagaccatcctgactaacatggtgaaacctcatctctactaaaaatataaaaaattagccaggcttggtggtcccagctgcttgaggcagaagaatggcatgaacccaagaggcggagcttgcagtgagccgagatcacgccactgcactccagcctgggcaacagagcaagactccgtctcaaaaaaaaaaaaaacatcaaaagatctggctagtccagacttgtatttcagacatgcagtaattcctttgagctaaaaggcagctgccgcctgaggcaggaggcacacgctccagtttgccaccaaccccacctctcccggttgccttgagagcgctttactcatgtgaagctacctgtatgggcactgggtgagtaggtgagcttctcactcctggcccagctcccagtctgaccacagagagtcccacctttgaggccagtggaactaggctcctgttagaggactgaccaaaggtcattagcatcttcatcaaaactcacattatcaagcactttctggatcaaatgcacagctggaccaccatatgaaaatgtgggaggggtccttgtgctggtgaataacaacccctggataactgggcaacccagggaagggccgccaaaggagcaagggttacaaagccaaatctcccagaccttgccttaggcctaagcctgcttccttcttctcttttccccaaaattgggctggaatcacctcttttctctgccactctgcagttccatcctcctaccctcagagtacaggggcagggatttctttaacagtcttcacacccagaactgagaaccaacctcccacctggctggccagtagagtcttttgaagatgagaaaaaaaaaaaaaaaaagaaaaaaagaaaaagctgaatgatgagcagtggcctccaattggacatcccctcaaatgaaaataaagccagtccaaatgtaagccagtgggaaaatgagacattatttacaattcatcacatgggtagctttccaggaacacatgccctgccaaacgtgggctgcctctggatccctatcaggttggttggttatctttcatcaactagtcattcgacagtttccctatcaattgctgtctactcaagaatgtccacaagaccagaggaagcggatgcatgcatatgtgcactcaacagaagtatctaggcttgtctaagggaagaaaggaattgtttcctaacaagattttaagtaactcctgtttctgtagatcctgagagtgagtcctagaagcagtgtgtcttaaaccctaagtggttgggtcccacaagctatttccctcgtcatgattgcactcagcagtgggtcctcacagaactgagttctaaattgtgagagtcaatgaaaataacaaacttacatttctcagctgggcgcggtggttcacacctgtaatcccagcactttgacgggcagatcacgagttcaggagatcgagaccatcctggctaacatggtgaaaccccatctctactaaaaatacaaaaaaattagccgggcgtagtggcagacacctgtagtcccagctactcaggaggctgaggcaggagaatggcatgaacccgggaggcggagcttgcagtgagccaagattgcaccactgcactccagcctggtggactgagtgagactccgtctccaaaaaaaaacttacatttctccattacttaccatcatcctggcattggactttatatagattaatttgtgcattctcaaagggggtaatattacttctaagcaagagaaagttggtcattaggagagaggggtttatcacatcagatgtattagatattacaatggcttgtgccctgcaaggggccatagcacataaatagatacacggtattctatagaattaacgttttgtgatggagtgagagggtgtcaagtcgaataaatgtctgaaaatattcttgggggaaggtgttaatggaaacacaagaggctcagagagcattgattcactcaatgcctccaacaacccatgagagaagagccattttgtcaatgaaaagttgaggtggggcgtgatggctcacatctgtaatcccagcactttgggaggacaacgtgggcagatcgcttgactccaggggttcaagaccagcccaggcaacatgacaaaaccccatctctacaaaaattagccaggcatagtggtgcgcacctatagtcccagctaattgggaggctgaggtgggaggatcacttgagcctgggaggtcaaggctgcagtgagctgtgatcataccactgcgctccaacctaggtgacagagggagaccctgtctcaaacaacaacaataaaatttggggcttaactgcccagagaagcccagcaggtgaggccaggttttaaaaatagatagcccaggtcctcagccgggccactggcttgattctgctttggttttgcacaccagggtctctttctttgttactgaggacggttaggagagaactggctcatgtccacctgcttggtcaggaaacaattttagattggtgtgtttggggtggccagttgagtgaatggctgtaggctgtgtcccaggcactacagtcacatttgcaacaattctcacattggcagtctgctgctcatgacgaagagacgtgtctacacctgaaagcaaaacttggcctgcagggtgaccacctcattctggtttgcccaggagtgtcctggaatcccctcagtcctgggagaactatctggttctcatttggaaccaggaggccccaaacccattcaaactaaagaatcttcaatggaaatttagtttccaatgagaatcgttccaactagatattccccaaaatgctagaatttaaaatagcagcttctacatctgtctcacctggctaagcaccctaagctgctgctggtctaaggcttgtcttctgacacaggggcaaacacacaagtaacgttgtgcactacaggatccatgaccacattctccttttgaagcaccactattagatcattcggtcacagaaagcatggtttgattggaattagaactcactgcctcctctggtgagtttgatgcttgacaacgatgtgccattttgtcacatcaaagaggttcacctggtgacatctgccatctctgctcatgtttgctttaacatcacacttctccctggaaagcacactgttgccctaactgtgctatcagaaatccagtgctgaatatagatctgaatgtctatgtctcaatacgtgattcgcttataggaatagcattttgtaaaaaatgagcctgacactttttgatcaggcaaaggaaatgtttagggatggagtcaaagaaatgttaagaacagcataattttgtcactgtcttttggagcatccccatcctcatggccagctgaaaaccccccgtcactctcagatctgcgctctcctttctcaaggggttggccgtgcttgaagtcacaggaaagcaaaacttcaaagctggctttcaaggtcaagaaaccaggcggcacttgctttaatgagagagctgcagtcaggaggaaggggctacctggccacaaggaagcgatcacacttgttaatcagcctgtcaggctggcggccgtgtccttcggcaaaagaaaatgacggcccaacttgagactttcaaccaggaacctgggatgttttcttccccctttggaggagctgctgctagttcatctggctcagggagtgacagggtgattataatttattttgtcactcaggagagtattgtgacgggggaaaagacagaaatgtactgtgtggaagccccaatgcgtgtctgtcatataattaccctttctctgctgtctggaaacacaagacaagcccggataggaagctgcatgagctggtgaaaacaaagtggtggacatggagtccagtgtgtgggactgcataagaggagaggcacaggcatcacccacaggcaattggagcaggtgcactgaggcccacctgctgcatgtcagccctgggcatagcattggtatgtgacccaggaatcccattccagcaaggacctccaaggcgcattgaacagggagctcagaggcagtcgtggaaaatctccaggcacgttgctcagttgttcattcttcttggaagacaaggtactggtggctctggtcagtgtggaatgaggcaacactacagtgaatggcaagaagccaattcaacccaaagaacactgatgaggacctaccgcgtgtcagacactgggcttacaaaatgaacacaacagtctataccctccaagagctcacatctaggaccatgtggcccatcacaaaaagatagacagttctgaaataaagaggttccatcaacagcaaagtttggtgagtgctgcagagagacaccctctcttggagattgatgctgtaagcgtgcttaatagaggcactgaagagtcctctggggaaaccttgctttgcggtgtttgccacgtatttcccaaatctgtttctcgactgaatctatggagccagagttcctcggaaccaatttagagaatgctggtttaggaggtttatccagcctttgcagaacacagaagtaaggaaaccatgatccagcctccaggggaaggtactggcaagagccaagcattgcactcagcagataggttggggttcaaagtaaagcctggtcttagaggccgactagaggaccacgtggagacatggtgtagactacagaatgtgtgtgtgcacgtgtgtgtgtgttgttgtgatatccacagtagaaacccagatctgcacactaagaccatgggcagggtgggagaagggacccggtgagagagagggctgtcctgcgaccctttgtcccacattctttggacaacttaatcctagtctcctgtatctgaggcctttgcctgcactgccataattggctcagaacccaggacagagttggataatgcaaggcttcctctctgaacactaatgtactaggcactgtaccaagttctgaaaataggtcatcccatgaaatcctcacaacaaccaaaggggaatgttgaaaacagggaaaccgaggctcagagagagatgaataatgtggccacggtcacgcagcttgaaaagacttgaacccagatacgtcacctcagagtcgttgtcttcaatgctgcaaacctatttacataactcaggcacaatgcggttccctcagaggcgcgatttcctccagagtaaatccagtgatgcattcgtgtctgggtgaagacaaacacggggcttaagaccgagttcacctgttccctaacaatccattaaaataaaaaccattttctgtgtatgcttgggaatattccaggataattttgtgttacatcatgttatccaacctgtaaacaaaaagatatcctcagtgaatttcctgatgaaaactaaagactcatcaacctgaaaggtcttttttttttttttcttcctctaatcattttaatgcatatgtcagttgcaagccatgatgacttcatttttataccttccatgacttcaattaaaggcagattaaatagggcacaaatccaatcaatcgagcattcattagacattaactaagtgcaaggccctgggtcaagtgtacttaactggagactggtgtggaattgatggggttaaggcctcctcctatgtctttggccacatggagctccctttagcatgtccctgggtaagatcgcaggcctgaaatctgcctctgatttctgatggggatatccttaagtttgcctagatcaggaagtttaatatgtgtcacatttcacatcagtttccatagactgtgagtggctgcctagaccactgttggataacactaattctgtagcatgtcaatgggagacagagtcatgctgttcctgctgtcttccagagacaggggggctgcatgggccaagaatgttcttttctgaagctgaaccttgaagcttgccctgagaccatctcacagggcaaagaagctaggtggataggaagtgcaccttgaagcatgtggccggatggcaccattggtgaaaatagctgagactgcctaacaaatcaatccaaccttgagggtggccagatcttcgttgtttatctgatcaatcaggcctaatgactgatactctgattccagtggtgggggaaaaaaaactggctttgatgattagagaagcattgctatggaaggaaaaggaattctgggtggtggtaaaaccagatgaattctatctttcctttaggcttcagtgttttctttgtatgactattcctgctgctttgttgaatagacatctgcggctttgatctcttccggttaggtcacactttgtgagtccagacagattcaaaatcagaagatgggccttatatttgtagaagactatattgggataaaaagttatggttaggcaggatgccctaatccaaatgtggtagcaatacaattgctattgtcaatcatcaaaaccagcaggcatgtttttgttggtgcttataattatgctctttgtaaattaaattttaattgccaaagcaatacattcaccttgtaaaaataaacaaaatgttatagatgaggccaacatctttcccgatgaccatgccaaatcccaatcccctctcttcttctccagatttaaccaccattaccagggagaagttctccttatagagttgttctatgcacttataaactgtacctgtaaaacatgtgaataaagtattgtggcatgttctgtgtgtaagcatgttcacaaaaatggtatcactatccccctgtgggtaaggaaagttaaaacgtgccacatttcacatcagtttctgtatacttcaagttgctacctagaccactgtttgagaacgctgattccatgacaaggtcaatgggaaacagaaccatgttgttcctgctgccatccaaaggcaagggggctgcatgggccaggaatgttctcttctggtgctgaaccccaaacattcctcaacctaacatttttactaattaatatatcttgaagagtttcccacattagaacccattagatctacagtctttttaagctgctgcaaaatatctcagtgtgagaatactatcattttggcaattcccctgttgatgaacagctaggctgtttccaaatttttcaccttgacagataattcagctagaaatttatttgcacagatcccttgcggacacgtgcagttgtttctgaaagtagatgccaaggaggcgaaggcattgtttttactctttgctgcccaatggtccttgacaatggatataccagtttccctttatatcagctgcatgggagggagacccattatctgacacccttatcaatcattgacataatccaacactccacatgcttgttatagaatcaggtcctatttgtatgactcttgcttgtttgtgagtgaacccaaccatgttaccctcattttatattggaagtccctaaaataacacggctgctacatagtaggtacacattagtgtttgctctcattccctttaactggaatgcctttttgctctgaggtccctttgacttgttcctgcctactctcttcttacgggtcctcatcagacacctttgtgcaaaccccagactagataaggttgttcatctctgtattcataatgccctctctcagtgtgcctgataagtcttattgtttgttatatatttatctcttctactgatttctgagctcctgcacacccaggagcatgcctctttgtactcctgtttccccaacacgcagcccaggcacatggagttggcattgaatcagagctttaaaaatgaaggccatggctagatggaatcttgtaatcccagcacccttggaggccgaggcaggtggatcagctgaggtcaggagttcaagacaagcctggctaaaatggttaaaccccatttataccaaaaatacaaatattaactgggcgtgatgacacacaactgtaatcccagctacttaggaggctgaggcaggagaatcacttgaacctgggaggcggaggttgcagtaagccaagatcacgccgctgcactccggcttgggtgacagagcgagactctgtctaaaaaaatgaatgtccctgtcacaaagccacatccacagtggaatgaaagcccctgaaaataaacagtgtatcaccagagggaaaaattaagcagtcactctgctgaacagcaaagatgttttcttctttatttcaggtcttttcatggaatgaaacagagagggaaaggaggaagaaaagctgaaacatagcaaagcttgggaaatacttttcttttttaatttggaaagtgatgggcacactgctgcactgctattgcccaggtggggaaggggctctggccgttgttgacccattgataaccattccgtgcctttctgtcttgccccggtaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagaggtgagctgaaaagaatacactttctttttcacgagaatagaatgtggctttcatgcaagggatgatgtggggctccagtcagtggttttttttaatactgtaaaggcagaaatgaggtgtttaccatgttttggtggggaaaatctataaagggaaatgggatattatgtgacccaagaaaacacgtgctctaaaaggctaaagcgcctggaactgtttgtattcactcaacctgatgcctatttcctcaacagccacttattctctaggccctggtgattctagactctgcctctggcccctgctttaatgctagaagggagagggaaggacaagggaaggaggggaagggaggagaggtggcttcatccaagatcacacaggctgtccttgttgcagagtcaaatgcccatgactcctttctccaaccctttgctgcaggcatcctgcattcccccttgaacccctctcttcctccatctctgttctcatccctttaggctttctccgtgaaatctcccccgtctcctgggtcacatgtcacaaacaggtgacccctggcccagtcagtccacatgcctgctctttcgttttgcctgcagtgttttacagcttttagaattagttgtcatatcaaaatatttagatttcacgtttctgttttaaaaatgccaatttccagtttttctggacatcagaaatcctggagacatcaggtccactttccacatgtgcactatcggtggtgtgaggtgtgatgctccagtggatccagggtctgctgtcccctttagatgggacatgtgctcccacctcgattacgtttccacgtgcatgggcccctctggtcctgccctttcctgagtttgaggtccaccgtgtagcttaccataagctactttaagtagaagaccctcgcggacctccaaacacagcatccttaaaccaactcgtggattcctacccatccttcactctccatccaccctaaacctgctaccattctggaattccctgctcctgacatcatcccacaggcgtggggccttggagttgtccttgaccttctgtaagaaccatcagctccacgtaactgctgggcttccctcgggggctctgtgcatttccccctcagtgtttttgatgaaataaatccatggttcggagtgttgtttcctctgctttctcctctcttatgtgctatagtttctcaagagattctggattacatcaaccccttctaagaagctgtcctcatccacctgattcttccacagtcttgttcttcctcccatctctgactactcttgcctgtagccatcatatagcagttggcatgtgctaattaggttgtcatttgtctctgaagaagattctctttctcttggtctagacctgaattgtccagtagagtaaccactagtcacatggggttattgcaattttaaagtatattaattgaaatcaagatgtaaaaatcagcttcacagtcacagacacatctcaagtgctcagcagtcatatgtggttggtggctattgtaccggacagtgcagacctagaacacttccatcaccccagaaggttctactgggcaacaatggcctagactgtatgtttcctgacaacagagactgtggtcatatgcatgtttatatttctactgcctagcatggttgaagtacttctaaaaatcctaattatatgtttgttggcatagagggaaaaaaaggaaaaagagttggaaataaaactaagatcttacataagctgtgagaaacagaagctagaaataggtaattattgaaagggagagacagagaaatttgcattgaaactctgattgtcctttggaaaatgtaatcgtttctagttaaagaatagggaagtagaaaaagtaatgagtccattatattcatttcatctcccattctctttccaaccctccctatttttttatttttttattttttttattttattttatgagacagagtcttgctctgtcacccaggttggagtgcagtggcacgatctcagctcactgcaacctccacttcccaggttgaagcaattctcctgtctcagcctcctgagtagctgggaatacaggcgcctgccaccacacctggctaatttttatatttttagtagagatggggtttcactatattggtcaggcttgtcccaaactcctgaccttaggtgatctgcccacctcggcctcccagtgtgctgggattacagggatgagccactgcgcccggccaatgctccctatttttatgactgacatattttcttcttttggaggccagtgatgacttcccaaggctctctattccccacttgacacgtgtgtgcaggtgcacacacacatgccagcttttctatagtccttaatgctcccaaagcttctcacaagatcctttcacaagaaaaagatgaagcatggtgatttctccgtttcagcttctctttgttctgagagaaaatattttataagtctctatttataaatcaaagtgataatgtagtaaattatcccatttttaaagtttattttaggggacaaatgtgtttccagctcatgatcttttcatttgggctttcattaagttgtaataagtatgtaattatggaagttgaattaagcatttctagtcacaaaacatcaacagccccccaaaaaagatcaactcaatttaaccgaaattggaaaatcaatgaaaatgaataaagagtgtcactcttctgtgagggtttccagagttcattgctgatccaggcaacatcagtgcaatccaaaggaaagaaatgtccctaaatttaggcaagctttggctagttccttgtgctgtgataagcttcacttcagcatgtttgctgaggaggtggaacgtgattccaagttcttgtctttgagggtaaaaaacttgcacatcagatgtccagtggagttccccagagtttgcaatgttttcctcccattgagacttggcactttttgtaggattcacatggatgcgatactttcttcagcaggtttgtgagattttattattaatattatttctgaagaccttctgagaaggcctgtcttaggtgtggttttaaagtctacttctcagccagatgggcagaaaaaacatttaatacagacttttgcagcattcatttaagaaagtatcccatttgggaccctgtggactttgagatgattcaagttgattttaaggtttgttaccttgtctcctgtcttcattcgcagtatctcaaattgcgtgttggaacaatgaatatagtgattccagttctgtcacaaactccttcaagagcaggagctgcagaaaccacacacacacacacacacacacacacacacacacacacagctcaccagcacctctggctctcacctgaatgagggacaaagcaaacgtgtgtttcctggcttgttgggagtggatactctggaatcccattgggtgacacgagctaagttgacacaataacaatttttcatctttattttccatttagtcaatttcctttcttaagtgcatctaccaaggaggaccccagcaggaagtgtttaaccaagggagaggcagatgatgcaagatgagtggggaggtggcaggcactgggaattttctgtgaatctgcctacctaatcatcttccctgccttttatagattcactttgtaacaaggcttgtaactgaggatagtcacacagggcagtgtagaaatgatccttactatgttgtcactttggttgttatcctttcttcttcccaccctcctcccttcccaggatgtctcacatggagccatctgaggcaggtgcactcatctaatctgctcctctcctgctccaaggattggcagccactattcttgaaagagtctatggcctatctgcttgcactcaccatagtcaatgctcaaacatgcaatttgtgggatgatgtttggcttgcccatgacctattgccagtacctagcacatgagagatgctcaaagaaatatctgttgagagttgaaaggcgggaaggaagtgaggaagacagcgtgattcacactggcttgaaagcaggtgaactggccatttcttccccttccatatcttaagctccgcattaatagatatcaagtttccccaagacatgtgcgttttccattacacgctcatccatttacttgttcggaaaaccctaccagaatatacgcttctggaagaaagggaccttggatttctgttctctctctctattcccattgccaaatatagcaccagataaataataggcactggataaagatctgttaggttatcagggtggatgagtggatgacctgtgttccttaagtttgtattatctcagaacattctgcaggatccacattctggcatggatatataaacagaggaagttactttattataggtgaaagcttagtcttacccttgtgcaatcatctggtaatctaatttattcactttatgtttaccttctgcaggaactgctttaagaaatagtgtcttggtccactgggtgaataggatggacaggagtatctgtgcctcttgcttaagtgtttggggagatgtttgcggaaaataagagccatatattccagtaaatgaaattaggttcatttggggcacttttttattattttctatagccatacttagccccccatttctggcatctctgtctatgtttttaaactatgtctggctgcactacaaaataaaatcagataaaggtctctaacgtttgataaatgttttatttagttgatcatcttggctgctagactgaaattcatctgctggaatctgccagctttctgaacacagccacaatttgcaactactcagagtaactaatggtcagggttttttttttttttcttttttaatggaaatagtttccaaaatagactcataaaaaagcaatcttaacatttgcattgagaaagtatcattagtctttttaaggggtttgagctgagcacttttctgtctttgtttgaatttgcctttaccttattatctattatcttccagataatctagggaaagtgatagcctgcccgtgaaaatgtacatataatacaagatattagggctgtgaatgtaatttgttttgtattttcagctggtaacgcactttctgaaactttataatgcccaaatttttaggccagatgtaaaaatggagagaatttctttctttctttccatggtaagtgttacataaggacttagtcttagatttatgtgcatttacttgctatgagatattcaagagtccttgaatatgtcagagaagaaaactgaagaatgttagggagaacatcctatgccatctagccaacgaatttggatgtgtagctgcaagcccaaagagaactatgtatttggtcaaaatgacccatgttaaaatattgtcacgtagcatgcatctccagaaacatactaaagacatctgtgaaaatgatgatatcaaatcaagctgccagaaaagaacaatggtaaaaaaggatagcatttcctccagtgccttcaatgaaagatagaggtagtagtcatactcttaggaaaataaatgtttttaggcctttctgatttaatgctaatacttttctcattatcatcatgtttaaaacattggcagtaattacacacaattcaatcatgctgtcaggaatattatcttgctttgttttggtgggtgggaccagaatgattcagatagtagcatcctcacaatttcttcgagctatttactcataaatatttctgttggggtaattttccccattttttttatcacttgctgctgtgaaaattgagatggaaaaagtagatgtaaataaattgccttattatttttaaaataatgcattatcctttcaaatgaaacacagctaaccaccctatgctaattgcacttgctccgttgtttcagcaaataaagtagaataggacattcaaaaggcagaatgctaagtcctggggtctgaaatttagttccatgagtgcaggcctcctgctgatggcaatggggattggtgggagggttagagatggggaaggccagggtctttatcttgtggcctcatttgctcctccactctggataaattctagaagaagaccttgatgagtctcaggactccactggtaaccgtaaccacttcccccatccctcttagtgtgacctatcaatccattaaagctaagaccgtggctagtctcttagtatgaccgcaatttagttgaaacctggcttcagagaaatgggccaagggcatagactacctgtgttttttgttgttgttgttgttgtttttggttttttgtttgtttgtcagttgtgagacctctctaaacctcgatttcttcatctgccacagtgagaataatcacaatcccaatctcattggcttattgaaaaaattcaaataagatgtgccaagtactagcgtgatacttatctataagcactctgtaaatattagttggtattagatgtttccatgattgacaatgagactgaagaagcagaaagaagttggagtttctcctacaggacgtacatttacactttgcccacacggcagagactatggcaagtttctttaaattgaatgaaagacagagctaatccagcctacaaaattcagcaataaaagctagtaaataagtattgagcaccacaaatgtctgctgaactcatggtgctggatatcaggacgcaaagattgagctgcctgcattggaggtaaagcagatatgtcgacagcacacgcatgcaaagatgtgctgttcaaaccgaaccttgatggctgtgtggaaacctggagtgcggaagcagaaggaagggcatcgtggggaaaggagtggcatggacaaaggcatggcatattcacatgctacttaaagactccagagatgaggctgtggtatagagagataccagaaaagggcagggagtttgaacaagattgcaaaaggcttctaatgtcattcaaacgattatagctatatcctactgtaaatgggaaaccaccattatttaaacattaaacacagctctgttcaacacagcattcacagagctgtgacttggacagaaaatgagttaagctaaaggagagatcgtcagtggcaaagttcaggcgttttggagacaggttgagactgacaagttggttctcgacatttctagcctgatggagataagagctgaggagctaccacttgaatctaaattctgagcttgttaaatagattaataaacctcagtccgtaggtattttctttcttctgttcttgggcttcttaaagtatcagacaatcagtagttactgggcacatgttgaatcaagagacacttaactttatcatgaagaaagattcatctttttagatttaacaaatgtttaattctctaagatatttcttttctttttggtattttatatggtaaagataatttgcagagtgatgatgaatttagagtacttctcttttttgtcattttaaatttcttcattttattttatatgaagtaccctaaaaagctaaagaatgttttcatttttggaaaaagttcttttcgagagctgtttatttttctttatcagccaaaaagtatgattactatgttaatgcaggttttgcttcatcaagagattttccagttattgaacttaaataacattgttctaaaccccaaatcctctaaattcctgttgtcagtgaaagaggtaccttctaatttggaaagaatatctagttcagttctgatttcaaaccagcagagaaaaataagaaaaatgttgctcctgccatatggagaatgaccatcatttaaggaaagaaaagttggttgagagtttttgggaagtaactgttttgtacttcctttaatgtactcagtgtccagagcaggaactgggtggttagaacagctgcaatatgattccactggaaagcagtttgcagagaggcaatcaaaagctgcaacacttagattaaggcaaactaatgatagaccatttcaagacatgatgacatctcaaaatgcctgggatccacatttctttcacttttgttttaagaggtatctcatttgctgtgccttttcataggataaaagcttgttgatcgtattatttagttgaacactttggggttctaaaagccgtgatcaaccttattggacatatggcactatgatgtcacattcaacaatgaaaggcacttcaagttataggatcatctattgcattggaggtcaggaaactttttttttaaagggccaaatagtaaatcgtatagactttcttggccaacaggcaaacttgaagatattattatcaacagaaagagtcaaactctataaaatttgaagagatttattacttcattctgaaccaaatatgagtgaccatggccactgactcagccctcaggagaccctgagaacatatgcccaaggtggtcgggccacaaataagttttatacattttagggggacataagccattaatcaatacttgtaaaatgtacaatggttcggtctggaaaggcaggacaactggaggagggtgtgtttccaggttataggtggattcaaatattttgtttggcaattggttgaaagagtttaaagacctggaatcaatagaaaggaaatgtctagcttaagataaggggttgtggagactgaggttcttactatgtagacgaagcctccaggtagcaggcttcagagagactagatggtaaatgtttcttgtcagactttaaaaggtatcagactcttagttaattctctcttggatcaagaaaaaggcatgagaaggggaaaagggattttctacaaaatatagtttttttcccccataagagacagctttgcaggactatttcaagatagggcaaagaaacatatttggggttaaaatatttttatttccttccttatctgtcatgtgatgttattgccagagtcaggctggaaagtaagccacattatgtagggttaaatgaaagccctcttttgagactttttggcttgtagagcatgattccccagatgtcttagataggaatttgggcaagtgaagaaaaaaggtcagagtttagtcctcattatgcaggtacttatataaccattaacagacaaacagagagccaaatcatgagtgaactcccattcacaattgcttcaaagagaataaaatgcctaggaatccaactgacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactactttaaagtaagtatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaaccataaaaaccctagaagaaaacctaggctttaccattcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcgacctacaaaatggggaaaattttcgcaacatactcatctgacaaagggctaatatccagaatctacaatgaactcaaacaaatttacaagaaaaaaacaaacaaccccatcaaaaagtgggcgaaggacatgaacagacacttctcaaaagaagacgtttatgcagccaaaaaacacatgaaaaaatgctcatcatcactggccatcagagaaatgcaaatcaaaaccacaatgagataccatctcacaccagttagaatggcgatcattcaaatgtcaggaaacaacaggtgctggagaggatgtggagaaataggaacgcttttacactgttggtgggactgtaaagtagttcaaccattgtggaagtcagtgtggcgtttcctcagggatctagaactggaagtaccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcgtttgtagggacatggatgaaattggaagtcatcattctcagtaaactatcacaagaacaaaaaaccaaacaccgcatattctcactcataggtgggaactgaacagtgaaatcacatggacacaggaaggggaatatcacactctggggactgttgtggggtggggggagggggaagggatagcattgggagaaatacataatgctagatgacgagttggtgggtgcagcgcaccagcatggcacatgtatacatatgtaactaacctgcacaatgtgcacatgtaccctaaaactttaataaaaaaaaaagtgaccattaaaaattataaaaagcattttaaagctcatgcgtcatcaaaacatagacagcaggctggatttgaccaacgggccatagttggccagcactggtctattagatcattggccacaatgctcagataggagcagttttatgtactgactgcagcatgttatcatatgtctatatctgaagtccactctcaaaatattaactcacacttattaatcatcaccttgaagtttgattatagggacagaaactaatcatgggtgatgggtctgatttcacattttgacagcatagttcatttctcccaccattaagaaacaggcaacctcagacagacacttggtaattaaatctagctcaaaatttggttacagtaatttttaaaaagcagtccaacagaaaaagagtaaacgaaaaagtgccatctagacattgactaaatattggagggaaccatcttggaatggctactttcattatgttagagccctgataggtgagaggagagggggcaaggggagacggagatgggaacagaagatttcccagatgaggggcactccctggagctgagtcttggagccagatggacttgttcacaccagcatggagtgaaataaggagaatcagaggacctgggctcataccctgtctctagaggctccaaaggagtccctgaggtaaaactgagattattctagagccacctggaaacaaaaagacactctggaccaggcttgggacattttcctgaaggtttcttccacctctcattgccctttctgtcattcctgaatttgagaatggggctgtgataacaaagaaactgaaagaacagtgtcaccatgtgtcttacatatcaccatgtgtcagtccctagaaaacgtactttatatggcatttgactttgataggaatctaatgaggtcagtaaagtgccctggttacagagatagagacctcaatgtcactaagatttaaacccctatcagcccatctccaaagcccatgcattttttctcccactatacaaatcaatattattgatatttatatgtgtggtaagcttgcagaataaatagattttgaactttctttttaacacagaaaagcaaaatacagtgaagttttggtggaactttcattctcatcaggccataggcttcagtgccgcattatcatatgggccaggtgggctttttccaggttactgagcccagtggcttctatagctcggttttaggaggctatggagaacagactctctcctgcccttggggggaaatgcaaatcaatacaggtcatttgttgagtattttgtcaataagaatcaaatggctttttaaagtacccctagtgttttttgatgcagaagtttcttgtgatcaaatacgtgtgcaaagatccagcaacaagggtttttgttggatctttgtttaaagcaccaaatgaaatggccaaccagtgggggtttgttcagtaaattatggtatattcctacactggtattctattaaatcatgtaaaatgatgtggcaaaatgtttaataatatagaaagatgttcaccatgtatcagcaggtggtttgcaaaatactccttaagctgtgatacttctttgtttatacacgtagagcatcttggtccaaggtacaaaaggatttgtgtgatgttttaggagtggtcctgttgggactatggttgattttaacttttccacagtgcagtgtctgagatgaccgtcttcagatctgggttgcttgagtctgaactttaacttcacctttcaccagccttgtgctagagaaacatcattagcttgaacaaccagtaaccataattatgatttgcatgtcataaaacattcttctctcatatcattgttaatgctccctgagaattcccttatcataatatggagaacaaatcccttttggttaaaactatgccttggtttcttcaactgtaaatcacagtaatgcctctctcaaagggctgtcatgaagagcaaatgaattaatacagcacatgcttaggagggtaatagctgagcatgagctattgctgttatctgtattttctagtttgggtgcagtggccacatgttatttttgtaatttagaaaaccaattctgttaatctttttttttgagacgaagtctcgctattattgctcaagctgtagtgcaatggcacgatctcagctcactgcaatctccacctcccgggttcaagcaattcttctgcttcagcctcccaagtagctgggattacaggcgcctgccaccacgcgcagctaatttttgtatttttagtagagatggggtttcaccatgttggccaggctggtcttgaactcatgacttcaggcgatccgcccacctcggcctcccaaagccctgggattacaggtgtgagccactgcacccggcccaattctgttaatcattttaaaaagcagttgtatcagtggtcgtaaggcaagagaaaggttaggatataacaccatgatgggtcaagcaacactatcacatttgaattcagacactagtttctttcttctccttcttcttcttcttcttcttcttcttcttcttcttcttcttcttcttcttcttcttcttctccttctccttctccttctccttctcctcctcctcctcctcctcctcctcctcctcctccttcttccttcttccttcttctttcttcttcttcttcttcctcttctcctccccctcctcttctcctccccctcctcctccccctccttctccccctcctccgcctcctcctccccctccttctccccttcctccctcctcctccccctccccctcctcctccctcctcctccccctcctcctccctctccctcctcctccctctccctcctcctccctcctcctctttttttttttgagatggcgtctcactctgtcacccaggctggagtgcaatggcacgatcttggcttaccacaacctcagactcctggattcaagcaattctcgcacctcagcctcctgagtagctgggattacaggaaaggcacccaccatcttgcccggctaatttttgttttatttttgtggagacggggtttcaccatgttggccaggctggtctcaaactcctgacctcaggcgatccacccgcctcggcctcccaaagtattgggattgcaggcataagccaccacaaccggcctagagactggtttctatatgagccagtttatttgttgaccaaacagagggagttgtgccaggaatcatggcctccgttaatgtttttaagattgcaggggaagcattccaaatgttttcaaaggtgtattaaggtaagtcttgtcaaaacattcccacttgaaataataagcattcttatttctttaagtaacagagacatagcaatggctttcctggctaaacgtgatcatcacagacacactgaccagctgtttatctttgcttccacaaattccaacaggcaacttaatagacattttgtggttatatgtttctaagacagccatgggaaatgaatttatttctacctttgtgaagaacagctatagaaatgaccattgaaattcagtgaatggcatttctgcttatgggccttaaaactgggaaccaaaattaaattcttttaggtattttctctcccgtgtcttctaaattgttgtgtgggctgatttttctccatgaaagactctcagagtcctaaattcaggttttctgtctccttgggctctagcattctggaataagcaagagtcaagagattctccattcttatttcctctgcatgttagaatatctaataggtgtgagacagtttatgttgtgctcagcattggacagccaccatgtaaacaattacggcgttttttcatccaggcattacattaggtccataacactcacaggagctctgtaaggctgaaattgccacatccattctactaggagggttatggagttcccaagggctgacctgcctttcctgagtcacccactggagagccagggcattggatttgacctcatagccgctgctctatccactcccttgggctattaaagaaaagcacgggacatattgatggaaaaaatctgacagatgtctcaaggacaactttatcttttatcagactcatttcagggatttctgtattcattgctcctggacttttcacatatttggggagcttgattgagtttccctcagctcttccattagaaagcccatgtggtacagtggctcagagcttgggcttaggaattcacaaatgtgaatctgtgaatctgagctctgcatcttattacttgtgtggccttgggcaagtcacctcacctacctgagcctaggtttctttggctgtaaaatggaactcatagcacggcctgtgtggaagacagaataatggctcctccccttcaaagaagtcctcatcctaattcccagaacttgtaaatatgttaccttacagggcaaatgggactttgtagaagtgattaagtcaaatatattgagattggaagattattctgaattatccagatgggcctgatataatcacagggtcttaataagggggaggtgggaatggctgggttggagatttaaagatgctctagtgctggctttgaagatggagcaagggcccaccatgcaagggctgtggacagagcttctggcatctaaaacaaaaaaggaaaaaaaaaggcaaggagagaaattcagaaggattgcagctctgcccacaccttgattttagcccactgagacccactttggactcctgtcctgaagtgtaagagaataaagtcacatggttaagtcactaaggacatggcagtttgttacagcagcaataggaaatggatgtaaccttttttatatggtttgtgggcttgaaagagatgacgtgttaaatacagtagcttttgaccttgaaagagacgatgtgtgaaatacattagttttgggggcttgaaagagatgacaggtgaagtacattaactcttgggcatgaaatacattagcttcatggccgttagcattggccatgaagagctcttgaccaatagtagctggtgttaccaataataaaataatggtgagacttgagatgacacaggagtgttctaacagaggcacagtccacttgaccagatctttctcaggcatctccatcgacagtggggtctccctagaaggctgggtggctgccatcccacccaaccagcctgcctgagttggtaaaagtgcatgaaagtgttcctctcagggggtggccttccattggccctcacaagggcacagcggagctcgttggttatgcttcagttacataaatccagccttacaaaggctacacagagagaggggctccttgcctcctagatctgtaccttgtaggtgctcaatacacattggtaagaatgttcacatcatcaggtaagcaaggggtataaagtgaggccttgaatcgctcacgtagattcaagtagtgttgagaaactaagaagtggtgaattgtacccttttttcccctcccaaattagaactcctaagaaatacaggacaactggagaccaaaccgtaggtttcattacctatgaagctgattaggaaagccttgagtttgtacccaaataaatttgctaatacttttacctaaattagagagattcggatggggtgggataacaacacgccacatctacctgggtggagcccatctcaggatgcctctgcccaggaggaggggcagtgagaaggaggccggaaggggaagagaaacaggagagggaaaggaggaaaggagacatagctagggagatgccactcagcaatcagaaacctccattccttttcctggggtggagtggaggaaaagggaaggggcagggaggctcctagcccacaagccacttttgtgcaataggaaaagatgcttgaccagtgacgatgagcttttttccaaatgttttttggccacagaagtgtcttgagaagtttctgttcatatccttcgcctgctttttaatggggttgtttgttttttttcttgtaaatttgtttaagttccttgtaaattctagatataagacctttgccagatgggtagattgcaaaaattttctcccattctataggttgcctgttcattctgatgatagtttcttttgctgtgcagaagctctttagtttaattagatccccatagtcaattttggcttttgttgcaattgcttttggtgttttagttggggggtggggggcaagggaagggacagcattaggacagatgcccaatgcatgtggggcttaaaacctaaaatatgggttgatgggtgcagcaaaccaccatggcacatgtatacctatgtaacaaacctgcacagtctgcatatgtatcccagaagttaaggtaaaatttaaaaaaaggaaataaaagatgcccgttcctctgaatggacatagcccatgccaagggtaaggcttggtgagtggaacaggctggattttaatcctcaggttgctgcacccttggtgaagcacagggcactagagaagagtgttcacaacctccagcccctccacaaagaagcctgattctggaaagacagaggttccaacctcacccttacttctcttctgaagatctgctgtgcatgaagcattttggaggtatttcttcagctcagaacacagcaactttcctatgaaagagagcacaaagggttaatgccaccagaagacactcagcctgtccagtgtcgctaccactgggacgggcaatgggaggcatctgaggctttgctgacaacttcttctgctgtgagggtggaaagcaggccagatctttatgacctggactccacgttttgggattctagcaagatgggacccactccgggtgctgtgcccattctcagtgccagtggggctgatatggggtcatggcaggtagcgggagataacagcctcatcctcaacactagacatccagacagagtggctcaggccctgtaagcaactggtgttagggcagataatgagattttctggtgtctgcttggtgacaagagtagtggcttcaaggaatttttttaaaaaataacatttgtttatagttgtgttttttaaagtagaaaatatattcatacgagcaagtaattagtgtcctgccaggtaagtctcatggtgacatgtcaacgtaattattttttaaagtctgcctcaaataaagcatcaaaatttcctgctttaaatctcctttctctgtaaaaatggttaagaggagtgaaaagagaggatgggaggggtctgagagcattgatgcctcatcatagtcagccagctgtggcaccacctctgtctttgcctgtcactctcatacaaaggatgtgcataggaaatgtgatcctacccatcctcaaattctagatttggacttgaatttggtgctcttatttccacattaagttaaaatctagcctccagatccccaggcttcccctcccattgtacccagaagaaacaagaattgtttctcagttctaactgtcataatgcctagcgggcgttagcctacaacgaaggataattcaatctatcctcaccttagtgtacgctggacaacactaggactcagaagtgctttgctcttgatcttgaaaggccagtggaaatccatgcagattcctcccccaggaccctcccagccagcctgataatgaattcatgggaaacagcctacatgtgagcaccaaagggaacacatttagtaaactctgccaaaggagcacagttcttgtaaagctgatgaggtttgtgattaatccttttttttttttttttttttttttttttgagaaggagtttttgctcttgttgcccaggctggagtgcaatggtggaatctcggctcgccacaatctccacctcccaggttcaagcgattctcctgcctcagcctccggagtagctgggattacaggcatgcgcctccacgcccggctaattttttatttttagtagagacggtgtttctccatgttggttaggctggtcttgaactcctgacctcaggtgatccacctgccttggcctcccaaaatgcctaacccagtttaaagagatccaggaagcagattgtgagctgcagatatgatgtgattattaaaagcagcctccattgccaacattgcaaacgcatcagcatgttccttccttcaacattccataacgtggtggtggtattcccaccttaccccgggagaagctgagagtcacagggagtatttactttccaagttcacacattcagggaatgggtagaagtggaattcacacccaggtcagtgtaagaccaaagaggctgtcagaatggtttgctgttccactcatggcaaacaggatttgaagttgttccagtccaagggagaccatcaggccatgcaggaataaaaaggccaaggggaggaaagaagatgctgtcttcattaaggcctgaaggaaaaggctggtcagagtgaagagtatagacaagctcctctgtatcctctcaaagatttggagccactgatctctctgggggttggggaatggggcagttcctgggaaagggacttattggtgggaatccagttctgctatgaatgctcctgactcctgcactcaaatcccaacagatgaaagggaggagagactgacagatgcagtgccttcctttatgtaacctccttgatccaaactacagtctgacccatgctttctggctttatattgtaccactacgttcctaactcaccctcgttccaatggcatcagcattttctcttccctcaaagataatgcacttctgacttttgcatattatggtagccagcccccaggagggctcccagtgattctcacctcatggtacccatgctcctgcgtggtcccctcccacatcgaataggaatgacttgtgtagccaaataggacatggcagaaatgactttgtgtgaattctgagccttgtttattcttgtcctttcttgctacaggcaaagccaaatgccgtgttgtagggaagctcaagtagcttcatggagaaatccacatggcaaggaactgaggccacctactaatagccagcatcaattctttagccgtatgtgtgagccaccttggaagtagaccttctagcccccatcaagcttttagataactgtagcctcaccaacatcctgactgaactacacagctgagcagcttccatatctccaagccacaaacactgtgtgcaatcataaatgtttttagttgctttaaagcactaagtttggggtaattttattcagcattagataactaatacacatagtctgtttcaccagctaaaattgctgctcatttctctgttaccccccaaacctggtgtgagcagcccctcctctgtggactttttctggtcttctttgcatgactcaatccctctttcttcattttctcacacagattgtttagcattctattaatgccactgtcacaaggaaaagcaatatttttattacagtctctctcctctgtcgattctaggcttcttgagaaagtttgtaatgtatgcattcttcaaagaggtattgttattaatagaggctcagaagatggctgaatgaatgaagagtgtgtgttagaacctggggaaatttaaaccaaatacatttaaagccagtgacattttcaaagcatatttggctagaaagactaagttctttaaagtagtttagaagcagtattaatggtacacagtctttgtcccattcttaacagtacaataatgataattggttgctactctggaaacaaattaaagagcccaggaaacgtttccaaaggtgactggaatgcttaactgagctagactgttaatatctaatgctagccttcctgtgggcatagcaccctgaattgcctgatctcatctaatggcacatgctcagacatccttggttttaaataaaaattgtcttatcacttagtttaaaaatgttttgcttagtaaaaaatttatgagggcaggtgcggtggctcatgcttgtaatcccagcactctggaaggccgaggcaggcagatcatgggctcaggagttcgatgccagcctggccaacatagtaaaacccgtctctactaaagatacaaaaattagcagtccgtggtggcgggcgcctgtaattccagctactcaggaggctgaagcaggagagtcgcttgaaaccgggaggcagagggtgcagtgagccgagatcgcgccactgcactccagcttgggcaacaagagcaacattcggtcgaaagaaagaaagagagaaagagaagaaggaaggaaggaaggaaggaaggaaggaaggaaggaaggaaagaaggaaggaaaaggaaggaagggaggaaggaaagggaaggggaggggaggggaggcgaggggaggggaggagaggggaggaaagggaagggaagggaatacatttaataaatgtggagtctgccaaatcaggtcggcagtttacttctcctgtccccggttcaataactcacttactggggttctggaggatagcagtgagaagatggggtaaaaaattagagagaagttttgcgttgccccatggctgcttctgtagtgtagtccgtgcatccgcccttcgatgcttgggttggatcatagagcagtgactgttgatggctcacccagatccccaggaacccaccactcccatacaggctttcaacctgttaatccctgcagctgcctgcctggactttcctctgaccatgggagtgtgctcagtcttactgcccagggaacagccatcagcctttgagtggcaagagttggtagattaccatcccttcttgacccttggaataggacaacttcgagatatgttctcccgagtctcccagatgaccccagtgagtttgaacaccagttgtccacagagataatctgcccattgccacctgtgtattgactcttttacatattctgtctcacttctctttctccctcacttgtgcttcttaagattgtatcctgaataagctatttgcactcaaataggcagagagctagctggatccattattctctcttgtcttctatattttagatatcttgtaacaggcacaaggtaccgtgtagagctgaggtgtaatgacccagctgatctgtttgtactttctcatgctgctaatgggtacctggagttgagaatttatgcataggtgtgtacatgccatcacagctctgtgtgcatgagtgcctgtggggtctgcatagcatgcacacatcacagaaaccctctgccctcccttctcattcctctatttgaagccaagtttccataatccctctactcaacccccttcttccccagcccccaggggcttcccatacttagggtcaccctttcttacctcagagtttcaaagatgtaagagctgatgcccaccttgatggtattcacaaagtatagcagggaggcggccatggaaatgactctttacagcaggatgatatgtggaacatgccatggccagggaagtaactttgtctcaaggggatcaggaagatgcccaggtatgggataacttgagcaaaagatttttgagcactgatctgcagattttactctctgtaaagggccagatagtaagtattttaggctttgtgggccatatggtggctgctgcaactgtgcagctttacttttttgtagcacaaaagcaagcatagataccacataaatgaatgagcatggctgtgttccaataaaactttatttacaaaagcagatggtgggccagatttgtcccattagctgtggtttgctgacctctgatttaaagagtgggaagtagatttctggaaagggagaaaggaagactatttctagcagagagaagaaaacatataaaggcaaagagtgggaaaccagagggaataagacaaatttgatttaccaaaaagtcctttttggtggtagtaaaaaatactaataataaaaactaagttttattaaagccttattatgagtcaagcattgggctaaatattttgtggattctcatttaattattactctctctgagtttggaggaccttgttttcctcatggcacacacgaggagtaaattaagctcagagagggtagatgactggctcaaggtcacacagctaccagctggccaggtggcaagaccccggacagaggattgggagcatggtattgtagccagcgtacctccttgtgtctatcattagccctgctttaatggactttttcagaagtgtttttgcttgtgttttacaagtggaatgtgattccttgactcagcccagtagccctgtgaatggatggctgaaacgagtctgacggctttttctcctggggccattttgtaagaaataaaagcaaaacagtgagatatttaaattcttcagggatattattttcgagtggataaagtgaagaacattttttattcatattagaagtgatagttggatgtgtgtaatttttttgctctccgagatggagagagaacacagcacagatcttagaatgtaaaatatgaatttagatgacattttgagaaaactgataaacaccaccattccacaattggacttaacttgcctgtgaaaatccttctgcagcccacaaaatgatagagataggtggactacgtctaatggatattaaaaatacacaacacaccaatgaaggaataattttcttttgcaaagttttcatttctcaaaatgctaccaggaaaagagagataccttgacagctgacagtaaccctgggaataaggatatgttagaagagaagggctgcagtagttgtgaaatcctacctggaatctacccctggacaggagacccagggatcaagactcaaagctgatgctctcaacaccaatgtttcatctccagtgtaccacgaggtccttgtccacctacttctagatagagccaaactgtctaagccaaagggggtttgggtttctttcaccacccacctgtgcacatgattagtttgaaaaagtatgtcttaaagaaaaataaatgcagacaactaagtgagaacagttacatgtactaaaggtctttcagaaaatcagtaatgtaggtcagtgcatttcaggatttggaatttcacacaaaatttacccttgaaaactttagactgagagaagactaccatgcctattctgtcatgtaaggacatctaaagaagaactgcacacattggtattaccatcttcccacacacatacacggacacgcacgcatgcacacgtgtgtgcacacacagacacgcacacacatgcacgcatgcacacacacatgcacacatgcacgcatgcacacacatgcacatgtgcacacatgcacgcacatgcacacacgctcacacacacagaatggttcgtggccgggtgcggtggctcacacctgtgatcccaacactttgggaggcctacaagggcagatcaactgaaatcaggagttttagaccagcctggccaacatgacaaaaccacatctctactaaaaatacaaaatttagccaggtgtagtggcaggtgcctgtaaccccatctactcgggaggctgaagcaggaagattgcttgaaccagggaggccaaggttgcagtgagctgagatcacgccactgcacagcagcctgggggacagagtgagattccatctcaaaaaaaaaaaaaagtttcatactttcactcacatatacactcacacactcgcacatacacctacacatacactcatacattcccatagaaacaagtgagttataatctcagagtgaacaaaattgagtaaattttaccatacaaacatatttattatgcttgtctcactaaaaagcagtaaaaattctgatatgagcatcacacaggttaatgtaagatagtaagaagaagaaaaaagtataattatcctagaagtcctattgaagaatgaaatcgcaaaataaaaatggaaggggcaaaggtaggatccttagaatgcttacaatgggaatctgaatgtttaatgagaaataagcccgacacccatagcacataaggactcaggctttgggatctctcccttcctagctttgaggcctgggcatgttatttaacctctcataccctcgaaaggggctcataaaagcaatcactgcatggggcttttgcttggtgaatagttccagcacatggttagtcctcagtaagtgttagctaatagcattagaaactagcttttttaaaaaataaaggaaggggccaggcgcggtggctcacgcctgtaattccagcactttgggaggccgaggcgggcggatcacgaggtctggaggtggagaccatcctggctaacacggtgaaactccatctgtcctaaaaatacaaaaaattagccagacatggtggcgggtgcctgtagtcccagctactcgggagtttgaggcaggagaatggcgtgaacccgggaggcgaagcttgcagtgagcggagattgcaccactgcactctagcctggcggacagagtgaaactccgtctcaaaataaataaataaataaataaataaataaataaataaataaataaataaaataaaaataaaggaagggctgggcgtggtggctcatgcctgtaatcccagcactttgggaggccgaggtgggtggatcacgaggtcaggagtttgagaccagcctggccaatatgatgaaaccgatctctactaaaaatacaaaaattagccaggtgtggtggcatgcgcctgtagtcccagctgctcaggaggctgacacagaagaatcatttgaacccaggaggtggaggttgcagtgagctgagatcatgccactgcactccagccttggcaacagagtgagactccgtctcaataataataataataatataataataataatagtaataaagaaagtacatggggaaggaatatgttctacatgagctttcacaggggcaccgatctagaccagtgtggactagaagtagccacatcccctgagatcctgtcggtaaaacacattctcgggcctccccacaaacctcttgatttggaaccctgggaggtggcacccaataacctgtgttttcaacaaaccctctagatgatgccaagccacactaaaatttgagaacctctgatcaagccctgcaagctttttaaccctggtcctgggcagtcagctaaatccaggaagtatttcgcagattgggaataaataaaagaagaaaaaaaaaaaggcataagtgtctttgggttgaatctcattttaagccccagaattaggcttgtgaaaacaattcaagaattgtcttcgagcctataatgcctgctagtcccatgagaaaaagattttgaaacaaaataagttgaggttggatttgctttttttccaagcttcaaagcatcaaacaaagatccatgttcacatctgaatatctgagttcacatctgagtcagccgctgactcagcccctgaccacagagtgatgaacagagaggcaggcatcatgggacctgaaatggcattttctccaaaatattagaacgtccttagatcccttagatcaatggtgatcgtgggcctggaaaacttctccaaaaagtgcaaacttctcctgtagttagcatattagtttgttctcatgctgctataaagacttaccctagactgaataatttataaaggaaagaggtttaattgactcacacacagttctttgtggttgggaaggcctcaggagacttacaatcatggcagaagggaaagtcaaccgtccttcttcacagggtggcagcaaggagaagtgctgagcaatgcgcagggatagccccttataaaaccgtgagatctcttgaaaactcattcactatcatgagaacagcatgagggtaactgccaccgtgatccaattacctctcaccaggcccctccaacaacacatggggattatgggaactacaattcaagatgagatttgggtggggacacggccaaaccttaacagttgggttcaaagacaaatgccaccataataggccgcagatcacctttattgccagcctctctagtccccaagtagctgataaaaacatagacaaaaattatagagaatgaaggaaaaaaagtaaggggttattttgagagcaaagtttgcctcatctgtccaatagagactgtcttgtatgttaaaagttcatcatcaggagctgaaagaattgaaagtaaaatgaaactatcttgtgtgcctcgtaggaatacaacctggacgtagtgtccattactaattaaagccaatgtgtattgtactttcacagtgagacaggccctgctctttgttctctatatttatttacatgcacttaatcctcacaattactccatgcaataaatcccattatcactttctgtactaggttgactagggtcctccccaaattcatgtctacccagaacctcagaatgtgtcttttcagatgtaattagctaagatgaggttatgctggattagggtaggccctacgtccagtatgccttggagtatcctcataagaagaggagggccgggttcggtggctcatgcctgtaatcccagcactttgggatgccaaggcaggtggatcacctgagttcagaagtttgagaccagcctggccaacctggtgaaacccaatctccactaaaaatacaaaaaattagccgggcatggtggtgctcacctgcagtctaagctactcaggaggctgaggcatgggaattgcttgaacctgggaggtggaggttgcagtaagccaagatcataccactgcactccggcctgggcaacagagtgagactccatctcaaaattaaaaagagaagaagaggagagagacagagacacacagaagatccaggagagaaggccaagtaaagttggaggcagagagtgggatgatgagtctataaaccaagaaataccacgggtcaccagcaaacaactagaagctaggatagaggccgggaacagatgttccctcagaacttccagaaggaaggactcttgtagatgtcttcttttgtgcttttggcctccaggactattagagtaaatttctgttgttttgagcccctccggtttgtgacgtgtagttactgcagctcctggacactgagatgcccctgtttcttgatggcgaaatggagactgaaagatcatgtcttacccaggtgcacacagccagcttttggaggtttagggtcagaggcagcttcgggggtaggaatctagaatctggtttcctcatcttgtgctgtgtcgtaggtctgctgggttcaggttctggagacgtcattccatgtttctgagctctcttttctcccctgcagatgtaagaactctgtacttgaggactcatgcctcagctgggtggtgggattggattccttttaaggtctctccaaaccaaccctgagcctctttgattagaattctagaagctttgaaaccaccactacaaaattcatttgcacgacatttctcttttaagcattacacttctctctgcagtaactttgaagttactgtcgttttatgcactcacgaagagttaacaagcaataataaacagtcaagactgcttttcatttcacatatctgcatgtgttcagtcttttccgtgacacaattgaaggagcttctgtaatcaggagagaaactttatatcatgctgtaatttcccttgatacaagctagaaaaagatactggtttagattcactggggtgattgactagaaaattgccccagctgtcaaagtttccagtgttaaaaagcagtgtaaaatttctcaaatgcttagaatttctagatgtcacaacagagatgttaccaaaatatgagaatcaagttttttataagcaggacaaaaatacattatttttctcaagttctcaatatttggttgaattcatgaagaaatttttaaaacacaccaagcaaagcgttcattttgtttagaaataaaattaataagttgttttttgatattgtattaatgtgtcctgccacattaaaagattgcctatatatttataaatttaatctttatataggaattaaacagacaagccagaaaaagaaaagaaatgataagctgatatttgggtataatattatcttgttatccatgttctttgtattagctgaattatttccatttctgctccaaccaagaaaatcaattcaaacattgttcctcgtgatttattcaaaaattcgcttttccaagtttccgtctaagagcatgtggtgggttcttatcttcatcataaaagtgtataacataaagagatgtcctcagatagctcatggcatttgttagctcaggggggttgtagaaagtttcctgtaagcgttttacactcaaagttttctttatagtgccaaagaatgagaagcaaaagcaattcagcactggaaccgtttggggagtgtggctccattctgaggttctcttctcatcagagtgggggcaccctataattttgagaccttgagccaggctttcatgtcatctctctttatgaacactccactagtttctagcctataaaaatagtgtcaacattacagtaagctaagtataaggcagaatcaagaagccaaggatctgattttatttcagagttctgaaatggaactaagtgttacagaaagcaatttgtgggaaacaattctctacagtatgacttatagactgcttcaaaggagaggtgtcttctcttcctagacctgggattttaatgtgagagctcccttatcatgttgaggagaatggctgtctgaattgttctccctcttatttataaaggcaatgatcagaagataatttgtaagtacctactctcttccaggcacagtatttaaaatgaatatatagtaaaaaagccagctgcctcccctgtcatcatggaatttataacttagtagagaagatgtcaaaaagatattgcaaatgatctgagtgttttttacaatggcattgttgtgtacaacaggtggattcccaccttgttggggaaagcaaggagtgctccctggaggaagtggtatttattttgagacctggaaattgttagccaggaaaggagataaagtggcgggagtgagagcaaaaatattgtcaccagagaaatcagtgagtgtaagaaattgctggtgtagttaaaaactgaaaaaagtctggatacattgactgtcgtgttttcccagttgtaggtcttgtaattctggcaaagggaaatatgaagtgaattcctggaatctcttgctgatcccagagagactacagttctagcataaaaggaagctcaacagggtgactgtaagaggttccagagcagcaggtcatactcagcttagaagtgcttgcaagacagtttaaggatgtagactgtctaaaagaggctcataaagagattatcaatctaaaagcaaacttgaaatattaatcagggctagattaggttatgctgcagtaacaagttaacccccaaattttagtaggcatagcgcaacaaagtttctttcttgctcaagctgtgattccaacatgggtctgctggggagctctgttccacgtagtcattaagggatccaggctgacagaggctctgccagcttgcagcatgtggagcactggcctcctttgtgcctgtggcagaagaacaaagagttacagtatcaaaagcagcccttaaatgcttcaaccatccctttggctagaactagtcatgtggccccacctacctgaagggagggtgagaaatgtgagggaacacgtgggcaatcaccaggaagttcctttgtttgttgcagtgacagtctggaaaacaatgtgaactggttgacaagcttaaaaatggatctaagggcaaaaatgctaaaggagagaaagaattgttgacagtgtataagaagatgattaggaacaaagtgagatgggcagtttggaggctctttttttagctttaatggtaatagaatacacgtggcactctcactaaatgcaaggcattgggctttatgtagattgtcccatttaattttcacagcaactctgaggtcgatattattatcgttctcattttacagataagaaaactgagccctggggtgatgaagtgactaaccccagtgatattgtctggctctgtgtccccacccaaatctcaccttgaattgtagttgtcataatctccacatgtcataggagggacctggtgggaggtaattttatcatgggggtggttaacctcatgctgttctcatgataatgagtgagatatcatgagatgtgatggtcttttgttttgtttttttgagatggagtcttgttctctcacccaggctggagtgcagtggcgtgatcttggctcactgcagctctgcctcccaggttcatgccattctcctgcctcagcctcccaagtagctgggactacaggcacatgccaccacacgtggctaatttttttgtattttttagtagagacggggtttcatcgtgttagccaggatggtctcgatctcctgaccttgtgatccacccgcctcggcctcccaaagtgctgagattacaggtgtgagccaccgcgcccggccaagatgtgatgggtttttttttgttttttgttttttgtttttttttgagacggagtctggctctgtctcccaggctggagtgcagtggtgcaatgttggctcactgcaagctccgcctcccgggttcacggcattctcctgcctcagccttccgagtagctgggactacaggcacctgccactacacccggctaatttttgtatttttagtagagacagggtttcaccatgttagccaggatggtctcgatctcctgacctcgtgatctgcccgcctcagcctcccaaagtgctgggattacaggtttgagccaccgagcccggccgatgtgatggttttataaagggcttttccctgttttgctcagcacttcttgctgctgccatgtgaagaaggatgtgttggcttcccctttcaccatgattgtacgtttcctgaagcctctgcattcatgctgaactgtcaattaaacttcttttctttataaattacccagtctctggtatgtctttattagtagcttgagaacggactaatataccagactctacagtttgtaacgtaggcactaggattcacagatcctaggcacctggttctcagattcgctaaactttaccattgttctttgtccgtagcctggaagcttagaatctggaaggatagagaatagagttttatagggactgggacacactggaaatttgaggaattttagttaggttaggaggcagttcctacatataggtggaaggagaaataccaggagtcttgtcttgtctcagcctaacaagatgacttctgagaatatgatcaggcctgtttccgccctagcattggagtccagtgatatccaagggcctttatcaggaaaactgcaacatatgaacacaacacagcctctgttttggagtccccagaagacagctgattggtttaagtaatagtctagggacaaagaaagaactaatacttcaatgaaaaagaaacaaatacttcaatgaaaatgaatttcatatcgcacttctacattccttatttgagggtatttgagcaaactaacagaggaagaaaattagccactttaactataataccttgagtattagactaatccagttataagtttacagaccctttgatcagaagtcagagaagttgcctaggaaatgagttaaacctatttctaaaatgtccaaaattagctgttcaaagaaatcttttttatagagcctaaaatattctaggcaagagataatgaaggatgctctagggcaatggtgcggggagaggaaagaaaggtgcctcaatacaagcagcatggcaaaggtacaatcctcccagtgtgaatggtggggggaacaaggggaactgaaaaacatgcatgaggacgttagctttgaatgggtttcttagagctgggggacaaaggaagagtcgcagatgatcagaaaggagatgtgaaatcttctgcttgctatgttgagtttgaaaaataaatgaaaaaatttcaggtaaaaacagcaaatcatagcaaataaagatctcatattcaggaaaagggctaggcctgggtaacttcatgatataaatgttcaccattgctaaaacttaaaggactgacaatatcaagtgctgacaagtatgtagaacaactaggagtcttgcaatgtttttcaaaatggtagccccagtcttgaaacaatacatatgacttctaatgacagaataagtcaatgactagaggtaaacagtgatgaaaaagaatgaatatggttgacactcacaggctctaagtggagcaaaagaagccaagtgtacaaaaaagtacattttgtatgattccatcgtttatgaagttcaagaaaaaacaaaaaggatttatggtgatagagatcagaatagtgactaccttgcagagatggcagttaggagaggacataggaaagcctgctggagactgggaatgttctctcagtctgggtattagttacatggatatatacttaagtgggctgcagggtttgctctgagggagcaaacacagcttgggctgtgtttggccttgaatattgtgaataatatgtttaggcaaaaatcctctgtgtctcgacgtcattgcatggatccactctatggttggccttagagccaggttcttgtttgcatataattttgcggaagtgtttatgtttgccgctcaattgccaattttgattacagcttctcagcctggaaaattgtcctggaagggcttaatggaacacttgcaggaatgtggcatcatcaattttagagccagaacaggacgtggctagcttttcagctggccgggaagagcctggagagtgctgagggacaccagccagggacaggcacaggatccaccacatggctctggcctcagttctgcccagctcaaaatcttcatccaagttttatttaaaaatcctttgaagggagagcaatgggctgccccaccaagagaagtgttcacaggaagtgcctctcctcaggtttcaaccatcgcctcccaaacttcaattttttaaatttcacctttgtaatgtctgctatttctaacatctgttctaatatatacttcatgtgctttttaaagcaacatgctctcttttacttcagtaaacatatttaggtaagacataccccatcaccacagtgccacagtaaatggaaaaccagcactttgctaacacgttttaaatttaaattattgcatgtactgccttgcgtgttagctctcagtaattatttttcatcctcttaggtttcttccagctttaaggctttattattttaagttataaagtaatcggccaccctgtatgactgtgaggtccttcaagagagaaggtactctttgctctttgaaatttaggaaaaaaaaaaagaatggaaaaaccaataatggaaaaaaaattgtatttttatgctaatagagtagtagcggccaggtgacctttagcaggttccttaatagtgtgtcaccaccaacacagtgtaaacaccaatacggtgtcaacaacagcaataaaatgcagtttaaagacagcttatcccagggtatgctatgagaattggatgagaatattgttaaatcccttgtgagttttaaagggatgtaaaagtcttagaaatattgatgtgatcattggcaaatgcagatggatattagagaaatcaatctaaattgtatatgtagacaccagccacccccggaaaagaacatgagtgggtaattcttccacctatgggttttcccatgggatgcaacctgggtgcatggaaccagccctggcttcagagttagaggggcctggctagtgctggttctgccactgaccttgacctgagtgaccttgaaaaagaaatctaacctcttgcattttcaataacttcacctataatacagggcaaatcatcctactatatgaggtcgttgaagtttaaatgaaagagtgtagagtctgcccttgaaacacgttgttatttttcaagcgattttctgaagctagagcccctcatgtgagggatggagagatgaatccatcagctgttaaatgcctgcattcgggtgccaggccaccttccttcctaggtaaggtctgcaaatccagttctcccctgctgcgcagagtgcaggtccagctctctgcccaccgggtgctgtctgtttagaggagccagctctggcttgcgctttaatgtcatgtttaatgcctgctctgctgcagcctccacatgtttattgaatctttatggaaaggccataacagctgcttcgggtccattataatggatcacgtcaaaatgtagcctgccattgttttaaagtcatgtattattcacttgatggagtgtatacgtccatcttatgtcaatttgtgttatggactgtcaaaattaacatgagtatatgaggtaaggcatattggggaagaaagttccacagcgcaatatgcaaccgtggagtttctaatcttaataattcagtgggtgccaacaagacgtggtctctattacagacttgaagctggtaatacttcatttttaaaaatgtaaccatttttgagttacaggaaaacaaaaatggtctgtggccaataaatgtctagttttataccgttctataaatgaaagtaataaagcacagcaaagttgccgagcgcagtgggttcttaaacacctgcagcgtcatttctcatcagcaggtgggcggcagagttcacatccctgggccctgtcggggtctggccatctccaggtggtgacaggtggcatcagactggcctgaattcagccttggggctgtgcattctcctggggcttattacagaggctctgacctccacctataggttcaattcccctccaccccaaggacttaaagaatttttccagacactttatgactcaccacctagtggctcttcccagtgtgactccagctagccacaccaagtccctttcagactcatgaccttagcaggtgctgttccctctgcctagaactttcttcctttatgtcctcacctggctgaattatactcacccttcagttctgctgaaatgtcacttctccaaagaagcatttctggacccccggcctccctattccaccctcctctggtaccccttttataggtgcttcttcctcatgcacctgtccaggttgtatctaaattagtaataaaagtttgatgtcatcctctctacccacaaataatgagtgcaggatccatgtctatggcgtccaccctgtagctgtagcacttagcattgtgcctgtcatgtccataataggtgctcagctagcatttttgaataaataaatgagtgcatggatggaagaaagcaaggttgtctggcagactgtcttggttgaacatgatttcctattcatgatgacctagcccatgctcttcaatcctgatagcttttttagattttttaagcccaaggctctgtcttgtcatatgtaccctacccttttcattatccttgaagagaaactcacctcccaccctggaatccactggagcagcctgtaccctgccaaccagtgccccccacaccaggactctctgccacgtgtgtgtactcaccaagtgctcctccatttcccattcctgagttggatctactccagggtcactcccttgcttcatggtagacccttgatgtcagttccctggcagctggcttgggctcttcctagcgctcagattccacctcagtgggcatgtccggttgcacatcccagaagtatatatcttccccattctgtggcatggttgcaaggacaacattgaacattgggaaaaggaggcaagaacgacaacagtccccatttcaaacacttcagtccctcgttatgcagctcctagaagtatccattgttctgggaaagatgaagcatccagaacctgtgtcaggactctagaatgaagattcaccttctctgcaccagcccagatggagagcgtcctgggcaaccaaagtccccaggagtatttgcacctctcaaccaagattcttagatcacagctcttaatcacttaccctgcagtccacccacaggagatgagctttatttcagttgtgtaaattagtgaaacagaaccccgaagagctgaaatgtcctcatatctgtcacgaccttaccatgcactagatttgtttccacagataagcttgtgggtttgcacgacaaccaagagaatttgcagttaagagaataaataatgcattattagaagaataaatcagcatgcagtgtacatgagtaatatattcataccaggcccagtgaaggagtagacacttatttagtgtgtttatgcagacatagatttaaaaatgtataaccacattattatgggttctttacaattgtaggagcaggaagttcacacaggtcttccagcctgtctagcaggtggactgagagtcatgaatttcatgtctttttcttttttctttttttttttttttttttttttttgagatgaagtcttacactgttgcccaggctggactgcagtggcgcgctctcggcttactgcaagctccgcctcctgggttcacgccattctcctgcctcagcctcccaagtagctgggactacaggcacctgccaccacacccagctaattttttgtacttttagtagagatggggtttcaccatgttagccaggatggtctcgatctcctgacctggtgatccgcccgcctcggccttccaaagtgctgggattacaggtgtgagccacctcgcccggccaaattgcatgtcttaacaccccctcttactagctgagaggtcttggcaaacctgtagcactgagagtgtcaagtttatccatctttaaatggggccaccatctaacacagaaaagccacagggatcagagaagaaatcatatgagtgggttccgtgggctgtaaatcctgaatgcgcatgagatgggaaggtcagtagaccaatgattttctcatcatagattcttgctgtgtcaacttggacaaaaaacttaattttcggggacgctgattctttttctctgtaaggagaagttattggtctgatgcacacagtggaatcaaacggcaatttacttgtaatgaaaacctctctctcccggtgtccttatagcaaccccagggacagactccagttggctctatctgtgcctcatgtccatcctttgaaccaaccacgggccagtagaatgtagtactcggattgaccaggcacctgaagtctaagacagcttccatcagtttcctgataactggcatttactgagcactttgtctgcactagatcctgtgtgtcatgcacactgacttatttaaccttctggacaacaacgtaaaataagctttagtacaaagagaagttctataacttgcctgtggtcacatggttaaaaagtggtgaagctggaatttgtaaacaggtttcttggactcctaagcctaatttgtaaatgctatgttatactgacttggttgcagtattggtgggagagggcatcctaaacagcacctgcttgttgccaagcccttgtggatttaagctcagttccttccccagaccttgtcgtgtgaacctccattctgacttcacatccatagtaggcaagataatggccctcccaaaggtgtccatgctttagtgccccagaagctgggactatgttgcctacctgagggacattgcagatgtgattaaggagtccttgagtcggggagatgattctgagttatcttggtggatccactctaatccaatgagtccttaaaatgaaagaattttttctggctcagagaaaatgtgaagactgaagaagagaacgggacagattgcagcataaaaacaactttgtccagcactgctggctttgaagacagaggaggggccacaaaccaaggaacatgggcagtcccaagaagctggaaaaagtgaagaaatggagtttcccctggagcctctggaaaggagtgcagcccttccagtagctagatgttagcccagcatcctgtgttggacttctgatctgcagaactataaaatttacagatgtgttaagacaccgtgctgtcgtaatttgttacagtagcaatatgaaagggatgtaacattcaaggcagaaccaaaaacaccaggaaatgctgcagccaccaccttcgaaccagcttcaaaggtcagccagtcatcagagtcagaagttttgttttgtgggggcggtggtggttattgttttgttttgtttttttcctctttattctgaaaagtgccagctctcaagctggggcaaaaatagctttgtgttgtagcctcaatcaatagtccgcaacctttttggcaccagaaaccagtttcatggaagacaatttttccagtgggattggaggaggatggtttccggatgaaactgttccacctaagaccatcaggcattagttctttagattctcataaggagcatgcaagctagatcccttgcatgcacagttcacaataggttttgcactcctatcaggatgtactgccattgctgatctgacaggataccgagctcagatggtaatgctcgcttgctagcccactgctcacctcctgctgtgtggcccaattcctaacagcgtacagactagttctggtccgtggcccgggggctggcggctcctggcttaaatgatgaaatttgctgccactgtttaaacactgactctttcacttccccagcccagcctgtacaatcttctgctttaccttctttaccttagccctttgtcccagtttgggaacagtgaaactgctggcaatcccagtaattgtcttgaagcaggcaggcagacagaatgggaattcaggccagggatggtggctcgtgcccgtaatcccagcactttgggaggccaaggcgggcagatcatgtgaggttgggagtttgagaccagcctggccaacatggtgaaaccccgtctatactaaaactacaaaaattaggcaggcgtggtggtgcgcacctgtaatcccagctatttaggaggctgaggcaggagatcacttgaacccatgaggcggaggctgctgtaagccgagattatgccactgccctgcagcctgggcaacagagcaagactctgtctcaaaaaaaaaaaattgttttaattaaagaataatttaaggctgggcgtgctggctcacacctgtaatctcagtgctttgggaggctgaggcaggcagatcacgaggtcgggagatggagaccatcctagccaacacggtgaaaccccatctctactaaaaatacaaaaaattagctgggcatggtggcaggtgcctgtagtcccagctacttgggaggctgaggcaggagaatggcgtgaacccaggaggcagagcttgcagtgagccgagatctggccactgcactccagcctgggcgacaaagcgagaccccatctcaaaaaaaaaaaaattaaaaattaagaatgggaattcagatacaaaaagagttgtcttctgcgttaaccgcagcacagggagagaaaaactacatctacccacagcattatagaaacggcccagggcaactacatccgtttgatggcattatagagatggcccagggcaacctgagtctgctttttcatttgtaagttagtgatgatatatacacctgacccaggtgctacgaaaggacccagtaagcaaatgctgagacaacacccagtctaggacttggcatcaaataagcaaccctataaatgccagcacctattacggttgttgttgtcatttgggtgataatggcactcaccaaattaaagacttttgagatcactggtatccatatcacactgtaaagtagaaagaagtctatattttctcagtaccactttaatgttaatttattacttaagtaccaacaaaacttcaaacaatattagagccagaggaaatattagagatcttcctcgaatgagttcggtgactttctaagggcacgcagggagtttatcgggaaggccagggctagacaatccaagttcccacagagctgataatgagccagaagtgggccccctacacacaggcatacctacttagccccatctgtatatcccaaactcacacagcctctttaataatcctcttaatagcagtgataactaaacatattcagctttaatcacacttgcacgcatgccttcttccttaaatctaagtaatatccctgcagctattccaaaaggaacactataactggctatttgccataataaggatgaggaaattttggttgatcacattttaaatgggaaactgtatttagagagattttaaactgcaaaattaaaaatgcaaacgtgaaattatttttccattaagtcttctccttggggaaatctcttcctctgttgcagttgggcggtctggatgggctggttacccttgtgtggggtgtatagtgaaacatcaactcccatgaggctcattctcaggggttgagataatagtagtccctagtggggtcgtctaagagcccttgggagggcacttatcttcatgtatatattacataaatcttatttcaaaagggatttctactataaatattagatcatctgtctctaaattctccaactgtttccatctatctctaaatttcccaactatctccatctatctctaaattctctgacagtgctgagatgtaacgaacagcattaaaacactaagcactgaaaaagagttatcatgctgaacacagtgttgtttttattctaatttctaaatccatgtctcgtttagcattggttgtagtcaagagagagactgttcaatcccagtctccccatgccttttttctttgttcattatggtgaagggatcatggctatataactgtttaattagcaggagtcaccttgagaaatgtcaccagggtggtcctgctcagttactaatggggtagttatatataaattgcttggtccacctgactgaaatatagtggattcagtttagggagtatgaaaatctcagattagaagagaagatggaggtcattccacccaaaccccctccccatgaatacctctgtcttttttttttttttttctttttcattgtagatctaggcgagcttgcttcttcaggaagttaagccccattgttaggcatctctgaagtacaagcagtacatagtatttatggttggaggtcagactctgaagtccagtgtacgtggattggaatcctagctttgcagtgtacaagctaattggatgacatatattaaacttattaacaggctttgtcttttgcccagaaattttacttctgaaaactagcctaaaaaataataaaaccttaatatttgagtttatatgtataaggatgtttgttgaagcattgttttttgtaggtacaaaaaataaaaggttagatctccattcacactacactgtactacatccattctaggaaatactatatggctttaaaaaataactgataatatctatgatttactagcccagagcaatgtacacagcttacataaagaaatgtgcatgccatttttttgtgaaaaaaatcataaaaattccctgtgtgtgtttttataggattctgtaaggatagtaaaagacatggatgatctgtactactgttttctgagtaatataaatggaaatagagattttaatacaagcacaaaggaaaattatgcataacagaattttatctattaaacgaccacataaaagaaaaatacaatattgatattgattttaaaaaagatgaaaataaatgtcaacatattgaacatttggtcaggtgattatggagcgctaatgtttttcttacatttctgttattttcatatgtatttgtaataaaataacgttattaaaatcacttataaaggaaaattagaaactacagtcctagttaagtaggagtgcaaaagaacttgtgaaatggggtcgggtaagaatctagtgacttctctggagttgcaagcagagggtgcctgatgcagacactgagctggacatgaagcatgttctctgaagattattgtctgtcttccttctaaacccatggctctgcgtacctgttcctgctggcccttgaagaggttcatatatttgaaatgagcattttgggggtgttcagcttggtgctattcatgataatttgtaataggttaaatgctttcaattaaagcttaagtcagtgaagctctcagttgagaaatatcagaaaattgagtgcactgtaaagtcagtctctgtaggtctccatagcttgaattttgtggagtcaccactgagctgaccttgtgctgagttttatgattctcatattagacaccttcttacacattcagatggcatttccagctggctgtctaaagttgcttcgtagtcacggaatcaggaccccagaacagagagccaaaattgagcactgtttcctgagagcactgtggctctgtccttgaggacagatttggcctgtgttaagttgttgatgagcaattgttaggattaatggtctctgtgagtctactccttctataacccagcacccaggctttcacatcaaccacgcaccaaccatcacagcagctgttttcaatctgcccatcatcttaaccacacacacaaggctgcagaattcatctcattaacttccttattttgtaatggaagactgaggttcacagagggacagtgactttcccaagtcactcaactggtcctgacaaagaaggactagcctatggcaatctcagattgccacctctatgttgaaatgacatttaccagtaactagccccttggcagagaggaacccatcaggcaggcggtctgtgcatggtgggtcagaggcagagctgtgcattcacacagactggattcaaatatcggttccttcatgttttagctttgtgactttcgctgggtcctttgatgtctccactcctccatttcctgtcctctaaagggggaatgctggcagtgtgttttcatgggatagttacgagcattaaataactttcttccggtaaagttcttggtgttgtttctgacatctaataagcaatcaaatgttacaactgccaccaccatggtagcacatcctcttctgggtaacacctatgttaaatcaacgtacatggcttgactcaggtgatatctgtaatcttgactttgtctgtttacatgtaactaggcctctggtctctgccatcctataaatccattcagcctttcagcctcagtttctcctggtagagcctggcatggcctgaaggcagcacagtataatagaaataggaaggtgtgtgtgatagactaaaagatggctcccccagacacccaagtcctgatcctggtacctatgactatgttaccttacacagcaacagagactttgctggtgtgattaagtcaaggatcttgagatgaggggtgaggggcttataaagcggagtttccctgcacaagccctcttctcttctctgccgccatgtgagacatgcctttcactttccaccatgattgtgaggcctctcagccagatatgctcaattatctaagttgtccctaaatgtaattacaaatgtccctacaagagggaggcgagtggtattgactgaagaagagggaggaggcaatgtgatgtggccactaacccagaaatgaattcagtctctagaagcaaaaaaggcaaaatatacattctctcccggagcctttggaagcagtgtggccctgcggccaccttaattttagcacagtgaaatggattttggactcctggcctccaaaactgtaagagagtaactttgtgttatttcaacctaacagtttgtggtaatttgttagggcagtcacaagaagctctgatatggtttagctgtgtccccactcaaatctcatctttaattttagctcccacaattcccatgtgttatgggaggcacccggtgggaggtaattgaatcatgggggcaggtctttcctgtgctatgcttgtgatagtgaggaagtctcatgagatctgatggttttataaaggggagtttccttgcacaagagctcttctcttgtctgctgccatgtgagatgtgcctttcacctgctgccatgattgtgaagcctcctcaaccacaagggactgtgagtccattaaacctctttcttttgcatattgcccagtctcaggtatgtgtttatcaacagtgtgaaaacagactagtacaagctcatacagtgtagaagtcactcctcaaaggtgacttctgtcaccaccctcaccccaagattagaagagttcccattgcaccttgaaattcattttcaaagcattcattgcacttgggactattagtttaatgcccagcacctggaaccagtgcttggaacatgggagtcccttaataaaatgttactggataaatgaatatttgtcttcccagagagacagtgagcttcctagaagccacatgcgggctctttgctgctgcatccagagtgcctagctcagcgctagtgcatggtagcttctccataaatatttgctgaatgaataaatggctgcttgtctcctcaagtagcctatcagctccacattcgccatgtcagtttcttcctctgcaatctctgcagtggcttgcaccatgcctggtgccttgtaagttctttgcaagcaatcattggccatctgcctgagtagtcacgctggtccggacttgagcgatcctctccctctgtccctttgcactagagcagttgtcccattaagccatgtgaaccctaccggtgtgtgttatgagccatgcgttgtgccaacatcccggcagacggaattcagcagtgccacgggagagagccagcggcctcccctgcatctgagcagcgtggcttgttagttcccagtccttcagccaccagctgtttctaacacaaactcgtggtgacagagctctctgtaggagaagctaactacaattgtcagtctgcagagcatcaggcatctctaaaaggattccaattattgttctgttctgcctgctcctattacagtctacctcaacatcagctcttattcagggagaggagagcgagatgctaactctgtctccactcactcttatgccagaggaccagcagatgccagcagctggtgtcacgctggagaagggtaaacataggtaaacttcccctcaatgcgacggctcacttttcattggtgtgtattgcacttaaatgtgctcggaaaatctcaactcagcgtgactcgcaacctcaccactgagcggaagataaatactgagatgcccagaggtgagtcatttttacagggcattccccaaagacaagatgggaggtgcctcccacactcttcacctcctcctctgtgggcagcaggtccctgcctgaagccgacagacaggaagtcggatctgtgtaggtagagttggcaggtttctcagctctcataatagctcatgggcattgcagtaaggacccagcacaaggaggtggtggaatggcacggcccacggcttccttagttgtggaagttgtgaggatttaagtataatttacattatcttttttttttttttttttttgagatggagtctcactctgtcacccaggctggagtgcagtggcacgatctcagctcactgcaacctccacctcctgggttcaggtgattctcttgcctcaccctcctgagtagctgggattacaggtgtgcaccaccacgcccagctaatttttgcatttttagtagagatgggatttcgccatgttgcccaggctagtctcaaactcctgaccccaagtgatccgcccacctcagcctcccgagctgctgggattacaggcatgagccacagtgcctggcacgttaatctattttaaaaatctagttggacttatttttaaacttgtttgtcaaggcaaaattcacatgacataaaaattaaccattttaaagtgaacaattcagtgccatttagtggatggacagtgttgtataaggcaccacctctatctatattctcatcgcccccaaatgaaaaccgcatacctgttaagtagttgctccccatcctccatcccccatgccctttgtaatcatctactttctgtctttaaggatttacctattctggatgctccatacaaatgaaatatgcaaagaggagcgcattaggaaggtggtctgttcatggtggttcagaggcagagctgtggatcctcacagcctggattcaaataccagtcccttcatttttcagctttgtgatcttggctaggttctttgacctcttcatttttccttttcctgttctacaaagggaaaatgctggcagtgcattttcatggggccgttacaagcattaaataaccttcttcaggtaaagttcttgctgttgaatctgacatcaaataagccatcaaatgttacaaccactacctcctcttcctggctagcacctatgtgaaatgaatgtacatggcttgactcaggtgatgcctgtcttttgtggccttttgcgattggcccctgtcacttagcacaatgttgtaaggtacgtcatagtgtttactgatccatatgatagcagaggtcagcacttcttttcatagctgaatagtattccactgtatggataggccacattttgtttgcctatcctttcactgatggacatttgagctgcttctacttcctcactattatgagcaatgctgctatgagcatgcatttgcaaacagttattcttatttaaatgtgaattagcagtgcgtatacacacccaaaattgggtcatcaaagccatgattttattgataatgatcaaggatttcttctttacacaaattcattagagcacaaatgtcaatgtctaggacaattttataggacaatctgaagaaagcaacagctcagctggaatgtggatatggttgaagtcattagtttaatcatatctgcagagtttcttttgccatataaggtaacactcacaggtcctgggaattattaggatcaggatattgttggggtcctttttcagtctgccatatacactgtggcctgaaggttcattaagagttaactgggagaccagagcataaggggtgctccaggcagagggcacagcatgtgcagaggccctggggcaagaggcagcctggtatgtgcaagaagaaaagagatgcacggctggaaagagacacaggcttttattggccaaattaaggacttgggtcagcatccaaaggacaaagagataccactaaagaatctcaaaaaaaggagtgataagttgattggcattttagtagatgctgtggccacattgtagatgggcaaagtagagggaaataattgtggattcagaagaagttaggaagctgttgcaatagttctggtgagaggtggccaaggcaaaggttagtgtgtgaccgtgaggaccaaaggaagaggacagtcacaggcatctgtgacttacagctgaccagctctgctttgctacttcattcgttgattccacaagtgcgtattgagatctcaacatggggaaggtgttatgcatggtgctgggaatgaaatgctgagccaactgtgcagtcctggacaggttaattaacatttaggcctcagtttccccaagatatgataatgttcattttttttggagtgtcatgaatattaagtgagtgaatggaaggaaagagcttaggacagtgcttgacacagaggaagtatttggagcagcaagcaagagaaaaagaaggaacgaaggaaaggaaggaagggagggagggagggaaggaaggaaggagagaggaagagaaagagaaacaaagaaaagaaaaggaaaaaaaggaaagaaggaaagaaggaaggaaaggaaggaaggaaggaagaaaagaaaagaaaagaaaagaaagaaacccatggacacccacagaaacaaccaccctggctttggccctcctctctctagagtagtcattgaaaaattcacccaggacaacatttgcatgaacacccaggaaatgggtggcatatggcatttggcattatgaggcattgagaaatcctttccgtaatatccactgagtatatactgtgagccaaaactatgatagcggctatgggggaaaaatgagtaaaaaccaacagtcattgtcttcatagagcttacaatgtagttggggggaccaatattagtcaaataagcatagtaagaaagatagtacaaggtaagagggggaagaccatgttgcaagagagtctttggtgggctgagttgacctgaccacggtagtcatggaaggtctccttgtggacgtgatccttggggtgaatcaagaggatgaggtggtgttaactgagcaagaatgggtagaaagaacatcacagggagagagaaaagggtgagcaaaggtcctgtggccagtgggaatgcagtgagtgtgggtgtagataaggctggagaggccaccaagagctgaacacccatggaaccttgtagaacaggctgatgggttttgtctttatactaatggaaatgggaaatccttaaagtatattaagttatatggagatatatacagagatgcatctttggaaagatgattctggtttgagtgttaaggggagatggagaaggagataagagaaatgtccactaggggactaccatattggttcaaacaagagacagcaattaggtggtagagatggggagaaggtgccacttcgagggctgtttaggagagaaaatcaacagcagcactagtgataaattgagcagaagaggtaatggagggtcaggtggccaggataacaccagcatttcttgactggtgcaatcgaaattgaaatggggatgttgcggatggaggtaactcatgccacaggtgtttcatcttctcagtaaagcagaagcctggctcatttgctgaaaaagagtgcattgagaactaaggcagaattttaaggacgtacaaacatttttgaatggcagctgtggggattcgagcaacaagaatgacttgcagaagtgatgacttaattgaaatcaaattgaaatacatagaaaccacagatttggagtaggcatttcatttgatatgtctcaaaggcccagcaggatgctctatctacaaagaaggtacagaataagtatttgttgagcaagtagataaaaccaaagagcgattttgcatgactttcctgagccaactgggacaatgaattggctgatctatgcacaaaaatttgtcctgctatatttctttccatggcaatccctgtgtagaactttaggctgcaacctaaaggtgaaatgcacttaatttggcttgaataatttacttggattcttccttatcaacaagacttgaatatataatgtatttgaatttgaatttggtagttatatgattgtttaattcttggggattggaatatgagggagataggaagaaaaggaaaaggaaccatttgctcacactctggcagatctaaagaaggtttcattactgtagggcttctcagaactttcagtaccctaagacagaagcttcttagacattatttgttctacaggaaaaaaaaagtgttgcaaagaatagctacatatagttattatctaatatagtggcattctatggaaagaaataaatctatattagattaccttgaatttgagaatatcacattttagccccttggaaggaattgtactctggaattatatctttggaatatctgatcaggccattataccaatcttcccatgtttcctaccatatttctaaaagaatattattttataccataactatattcaacatagtgcctatttctctattgccttcctaggaatttaattttgttgtctaaatgggggaagtctgtttcctttcccagttacggcccaaataataaatgttgatgttaccgtgctataaaaatatgtcctctataaattgctttgcttgtcattaagatgtttcctaaacaagttgaatatgcgctatgtttttgccagacacttgaagcaatcttaaattacctgctgtgtctacacatattcagaaggccataatagaaatgtgccgagtggctcaggagaaaatcatttataaagattagaggaggacttgggaagctctgcctcttgttgcttggattgtgcacaaatacatttatttctgggtatgtttaggttatttcttttcagatttattttggtttacaccgtttcccaagcattagtcatcactgtcccctgaagcagtcacactatactcatctccgtagatgatcaatcagaatcttgagagtgaaatgaccagttaagacagaccaacaatttgttgatctagtggaggcggaaaaaatgcagtctgaattgaaatgacttttatgagatttcacccaggtggttgtttctaaatttatactcaaaatatagagtgaaacttgagagaacatttgcaagaaggaatgtgatcctaaaataataggatgtccttgttgggtgagttgaggaagtatgatagagccatagaggaaaagggtagattggcatcgacttagtagcgctgacgatcatttttatcagggatgtggatgtaggcacagaaagaaaggcatagctcttagattagcagaagagacaaggttggaaggaataattgtccagttagaatgcataatctgtttttaaagacatattaaactggaataacccatgtacaagtatttatccagcttggatacctggaagtggaattcctggttgaaaggtatattaatataaaattttgtaaaaaaatatatgttagataatgcttagtcatccttcgcaaatatcatgccaatctacatttcaactaccagggcacacacttgaacccatataaacagtggtctattctgaggacttttcagaacttttattaaaccaagattcattgtaaatctttgagggagtcatctggcatacaaagtgttttcgaaactttgattttaaaggaactcatactaacatcttgagaatctagtatccttagaacagtggtccccaacctttcttggcaccagggaccggttttgtggaagacaatttttctgtgggcaagggtgggggatggtttcaggatgaaactattgcacctcagatcatcaggcattagttagattctcataaggaacatgcaacctagatccctcacacgtgcagttcacagtagggttcacgcttctatgagaatctaatgccatggctgatctgacaggaggcggagctcaggtggtcatgctcactcacttgccactcccctcctgctgtgcgactcggttcctaacaggccatggaccagcactggtgtgtagccagggggctggagacccctgccttagaacacaattcaagaaatgctagtccacatgaaagtgaaaggctgaaaacttgcagaaaaggaaaaccgaaacattgaaagagggaaaatctgacaggagaaggcacagagatgagcatgagggccatttgttgaagtgttggtaacagcgataatgataattctagctgatattttcagagcattttctacgtgtcactcatggagtcctcacaagaacttcacgaaataggtactgtaattattcccatttcatagatgaagcaattgcagcatagggagatgaagtaccttgtccaaggtcatgcgaataggttagacttattcactctgtgtggccccagaggaggaatggttctagaaagaaatattttagcttaatatttgaagaagggctccagcagtcagaaactgggcatcatctattagggatatctccctgagggagaatttgagcgtgattaattccctgacattccattggtggaactcattctttgactttagataaaattctcttgcttctgaatctctgctaatttaggtggtttgtcctggacaagactgatttttaaaattctttatgttattgtcaataaattttttttttttttttttgagatggagtctcactctgtcaccaggctggagttcagtggatccatctaggctaacttcaatctccgcctcccaggttgaagccactctcctgcttcagcctcccgagtagctggtgttggaggccgaaagattgagggtcgtgatcaactcagtataccactggaggctatatgagtaagcgccaaactggtcttcataaatgcagaatgttggcagaccgacaaactgcgtctgctgccccgaaggagtgctgaagacagtcacccccgatgcgcagtgtttcttgtgattaggtacatctgaagcctgttagtaataatataaacctgtgttcagttaagcagctgaccagtcattaccacctcctccttgctctttctacccaataaatacaaagggctctagaagctcaggggtgcctttgctcactagaagcagggagctctcttcttcttccccagacccttcctttaaaacagtttcttttgtcttaagtttccatttctacgtttgtccctttgttcagtctcgtaatgacactctcaagtagtaacagtagtaactgtcctaatgacatctcaagtagtaactgttgtcatgatggtctcaagtagtaacagtagtaactgttgtagtgactggtctcaagtagtaattgcggcagtcagccacagctggaattacaggcatgcaccaccacacccagctaatttttgtatttttagtagagatgggttttcaccatgttggccaggatggtcttgatctcccaacctcaaatgatccgcccgcctcagcctcccaaagtgctgggattataggcgtgagccactgcacctggcctattgtcaataaaatatttttatatccatgatgccagtttgtttggtaaatgtgactacagagcccagggtgaaaagatgtagaaattgtcttgggatcatcttgacgtctcctggttggagtattcatgttcactcccgctcaatccccaggtcatatggcagtctaatctcagactctcagcccagctgccacctccagcctctggcctacactagtgcccagtggtgagcaaagatgttgggaagaaatctggatgcatctaaccctgctgcctgttgagtatcaggaagctgcccaacactcttccttagaaaggttttaacatgtcataatattgaggcattgaaaatctaaatgaattcttctgattgttccagagaagctatggaaatatgatcacttcattatcctttaccaaatgttcattgcatgtcttcagtccctcacattcccaccagctcctctcttctttgcctgaccaaccttactcatcctttgaggcatgtggcagagatcgtgtgttcactaaactctgtttgttttcactcttggccatagttagacttaattttccaaagttccttgcagttaggcagggccatgaaacagacaatggaatttggtagaagtcatcaaaccactccttcctctcctcaccttctttccccatccacaagctgaaccaaggactccaaaggtctagaggaaggcacagcccaagatggaaggacctgaatccctgactcccccaagacattgagcaaagtggaagaaattcatggttggtttttaagctctttagaaacagtggtttatttgttgcagcagttaatgttgctctgcctaacataagactctgctctaccacatcaggtttcttcatgggtaaagtaaggtcttctcctatgagaatgtatagagccctagacagagcttgcatcatagctttagaatgcaagccccatgggacagaggctgtgtctttcttatccatcattgtacccattccctagcaagtgtccagcatttggaagcaagtcaataaatactagctattattgctattagtattaatgtgttagcgttgtctgacccttgctccttacagtgtaggccatgggccaccatggcatcaccccagagcttgctagaaatgcagagcctcaggcctcatgctagtcttattgaattagcatctgcattttaacaagactctcaggtgaggccattcctgctgaggtgcacatactaatatttgaaagacatcactctagaccagcagttctgagccttggttgcaccttagagtcaccctatcagaattcctatcagaatctggttttgtttttgttttaaggcttcccagatgaatgtaatgtgcagccaggattgcaaactactgctccatctcagtagttctcaaacactagcctgcggcagaatcccctgggtgttaggtgcgtatcacaacacagattgctggatcacctccccacactgcctgattcagtatgtctggcatagggaccaataacgtgcatttctcccaacttcccaggtgcattcgtttgcaacggctgtggtaacaaagcatcataaactaagtggcttacaacagcagaaatgtattctcccatggttctggaagccagaactctgaaatcaaggtgttggcaaagccatgctctggcagctagtccaggggagaatccttccttgtgtcttccagcttctgatgtttgccagcaacccttggagctctttggcttgcagaagcatccaccactccagtcctctgtctttacacggctgtctccgtgtgtgtcttcacattgttttccttgtctgaacatctgtctctgtgtcctaatttctcatttttataagaacaccaatcatattggcttagggcccgtgctcatgacctcattttatcttgtttacctctacaaagacttcactttcaaataaagtcacattctgagatattaagggctaagacaatcaacataagctttttgaggggacataattcaacttacaacagcaagtgatactgatgctgctggtctagcaaccccagcttgagaacgactgccttgttgtgagctgcaaaagtgcaaagacaacattcctttctttcagtacatcctacccagagtgtagcttggcgcttggcacatcgtatgttttaagtaactataggttgaattaattaatattctttccacacagcaatttggcctgcataaaagacttcgatattttcctgatgttgccagaggcttaatgtgtgacatttcgtatagcaaatgctcaataaatgttgggtgagtgaacatagctgtcactcctcattacatattttaaaaacaaccttagtgggccttcatgcttttattccaccttatggagcccaatgacagaatgctgattaaatgacatggctcctttaatgggaaattaacaatctacaaaatgttgtggattcagtaataggcatttgaggcgctgactatgatgatttgttgcttgccttgccttgattccccagtgagaattcatctctatttagcaagtgctgtgatctactccagtaaaggagatctctttctttgaatcccagcaacctctagcttggtctttagcttcatatatcactgttaattttcacctaagtcagtggttctcaactgggggtgattgtgctcctcaggggacagacattagagacatgttttggttgtctgtcgtgagagcagagtgtattcccattccccagctgggaccagcgggtatgctgctctcatctaatggacagtggccaggggtgctgctgaacatcctacagtacataacacagttctcatcgctacagagaatctctggccccaaacgtcagtagtgccagcgtagataaaccctgacctaagcaaagacaaaatggacatgaagttgcctcaatgggcaagaccaagacttctgagccaccccatcagtgacacttgatgtagccggtagcaggagtgccagggagaacacagctttgttgttccatatccagctgtttggatcagagggaaatgggatctttcaatcactactgcagtatgagaaagtgagctgcacccagtggttactaggtggggtgctctgtgcagtgtgcttcgagcacaccctctcactgaatgtgagatgatgctcccactcgcagtgtctctgaggtgagaactattacagtccccacattgcagaagaggagtctccagcactgagactgagtagttcacccaatgtcatatagggtggagtgttaaagtcctaaataaaacccagtctataggacgattgagtctgtgattttaatccctgtgtagtctgggtttacatttccattcagattcctgctccaacatttcctatagatgctcctcaacttacgatgggtttatgacccgataaacccatcgtaagttgaaaattatcattaagtcaaaaatgtatttaatacacataacctgctaaacgccatagcttagcctaccctaccttaaacacactgagaacacttccagtacagtattcaataaattacatgagatgtttaacacttcgttataaaataggcattatgtcagatgattcatcccaacatcacaagaggatatggcaccacatgttgctaacccagaaaaagactagaattcaaaatttgaaatacagtttctattgaatgcatatcactttcatactattgtgaagtcaaaaaattatgagtgaaatcatcgtaagtcagggactctctctagctgcattgtgttgggcaagggatttaaccctcaccgtctttgtttcctcatctgcaaaatgaggatttataacagttcaaagggtatctactaggattaaaagatacaaaatacatctaacaatgtctggccacagtataagctcaataaatgttagttcttctccccgttagccgtcattacattcacaggtattaagaaagagaaatgtataggtatgatatgtaattctcttagttaatgagactttccttaaactaactagaagattccattcactggaaacatacttaatgatgaagcttttattctgttcatctccttcagggagtacttaaaaataactcacaagcccattgttagagctcatgttctttacccaaccaggatttaattagtccttcagctccttagcccttcttagaagttgttcgatgttaaatcccacatgacccttgggtgggaaggtgtggaaaccctccaagcaccatctgacatacccagtgactaggaagacttcacagtaagagttaaggatttttaaagattgccgatgttaatgaagaaggaaaaaaaatagtggatgtgctaaattagatatttacaaattatgttcctctctccaggggaagattcattaattttcaccgtaaccagcttcattctattgggacaccagaggaggatttgcagattacagatccagccacatctttctcatgcttaaagaagtctcattgtctgcactgtccagagaggggaaagtccactgcctggacaaggccttcatggctgttcacaacctgccccagcctccagtccattacccttgcctattttgttgcagtgatggaattaaagtccttctaatgaaaaaggctgtaggtgaattttaatccattagccatctaccagacctcctctgccatcctttagactctccatacagttcctctccctgccgtatcttcttgtgtgtcaatatttatatcaagcaagccctcctcatctgcccaccctttatctgccaggctaagtccaactcctacttcaagaccgcattcaaataatgcctcctgtctgcagctttcctcagcttccccatggagaattgatggctccctttctttgagcgtattcattcattcattcattcattcaatgacaactatctaccaggagctgttctaagcattggggtgtggaggtgaacaagaaagcatagagccattgttctagctggggaaccaatatgaagtaaaacataagctaatacttaagtccagaagttcagaagtgataagtgctctgaggaaaatatggagtgatgaggaagagtgaaattggcagagtgaagagtgatatttgatgaggcaatcagaaagagccattgtgaggtgaggtttgggctaaaacctgcataatgagagggaagcatccatcctccaagtgtagagcgtgggacgtcttggtagatacctcaccagctcttcccttctcagaggctctgaactcctggagggtggcactcttggcatccccagactcttggcatccccagtactttgtccggaattcatgcatagcagcagatagccacaggtgatggctcaagtgccttcatttaatttaacttaaaattttattttcggttgtacctgttatgcatttgttagccatactactggttttttttttttttaatcaaagaagaaaatagctattgcttcttttttttttctctgggttcaagacgttctggaaacaaagtttgaaaaatccatttaggaaatgcaatttaagtgccagataacatcttgggattggcgccatgatcgatgaggtctgggtataaccaacgtcttatgccatgtctctgatctttactcaaattcacctcctattctgggtagcgaagtttggggagacccagtggtgtggagagagggttgtgtttagcttctctttccctgacctcagagtaaacaccagccatctgcataacagcagtgcccttccatagtacttattaggctattgttactcagttgatgtcagttggtgccactagacagagggcactgcagccccatggccatgtctgtctttctgaaagattcaagtgccagtctctttgcatctggcacacagtaggtactctgaaaagacttgcaaaatgcagaaatgaatgaatgaaggcacaacaaaaacacggaccggaagggacacctccggtcctgaacagcctggcttcaacttcaaggaccacagttggcttgaattttaatccatcaggtcatctccatgtgttcactttcttccataaaggtgaatgtgtcaagcactgtgcaagctgccaggagaatggtggagtatgataaccatctagtgggggaggcaaacttgaatcgaatgatggcacaaataagtgtggaattatagagtatggtaaaagctaagaaggaaaggcaaacagggcttcaagagtacacagcagtgagcctggacccagggggatgtgggaagcccaggaacctggataagtggctgttgttgtttaatctattttttagctttcattttagtttcagaggtacatgtgcaaatttgttacataggtaaactcatgccatgggggtttggtgtacagattattttgtcacctgggtactaagtatccaatagttgtttttttctgatcttcttctcccaccatctaccctcaagtaggccctagtgtgtgttgttcccctttgtgtgtccatgctttctcattatttagctcccacttataagcgagtacatgcagtatttggttttctgttcctgggttagtttgctaaggataatggcctccagctccatccatgttcctgcaaaggacatgatctttcttttttatggctgcatagtattccatggtatatacgtaccacattttctttatccagtctacagttgatgggcatttagtttgcttccatgtctttgctatagtgaatagtgctgcagtgaacatatgcgtgcatgggtctttgtggtagaatgaagtcactgttgagccttgacctccaaggctgaaatagataaaggagtgaggagggtgttgtagtgggaagctgtggcctgcagaagctatcctggggcatcaggagctgctgggggagggaaatggtataagacagcagaccaggcagaccaagactgggttctgtaagctctgctaggaatcttccttggtatctgcagagcacaggaaagcttttgagagatttcagtggggagatgatatatgcagagctgagtctggaattatcacctgggctgcttgctgccagatagattggagcaggaagggggggatgggaagctagccaagagcaggtgtccaggtgggagagaatggtcacttaaacctagtgggggtgccagggtggggagaggtagacagattgaggtgatatttaggaggcaaactcaacaggccttggtgatggcttatttagctcagtggtcctaaaccagggacagttgtgtcttccaaggaacacctggaaatatccagatattttttggttgttgcaactggctgggagattggtgggaaggggatgctactagcatttcataggtaaaaactaaggatgtggctaaatatcctacaatgcaaagggcagcccctcccccaacagcaaagctttatctggccccagtgtccgtagcgcagtggttgagaaacctggcttcagatgtagaaacatcagagatgcagtgtcagaggtgatctttgggtcttgtcttgctaacaaggtgaaaggtcatgccattctctgagatattgggaccccggatagccagttcttttacaaggggtatgtggtgtcaatggagaccagaagatgggttcctgaggcatttggagacatccaagtgaggagatggcttgttttcttcctaaattttcaccatcccccacaaggcagcctttttttttctctgttaatgaagtttccagccaccttacccttgattctcaccttccaaccccctgccttccaatattccacccctcttttttctgccctagaggagaaacctatgatccttgcattagaatggttttcctgccatcactattgcaaaatagacaagggtaaaagaaagccttcagtagaatttcatctgagtattttctttgcccccttgtgtgtcattttctccttaagaaaactgaggaagaagtgtgatttagtcccctcatctgcataattttcttccctgtgtggctgtgtgcttgtcagtgctctgacagatcaagagtgctctgaaagctcagaggagcaggaagagacccaggtgacctggtgagagccacgctgaatctcggttcacatgtcgttaacggagcttggtccttggagggccttgtggggaaggacgcagacaagctgtgatggagtccttgggtctcacctgggagagcccacgggagcacctgtgagttggttccgagaaaacatcccactctccaggtcacctctctgtgcttcaccccacctctcattcttcttttgtgcaaagcacctatttggaagtaaaatatcagctagaaaggaaaggagtttcagaagaaagtaccacatcagcgttttgaacaaattaagttgtgtgcaagctgagcagcctgtatcaaggggaacgtggtagagggatgtgagcctcaggctgcctgctgccggttgcaggctgccatatgcttcacctgcttgtgccctcgagggtccccttctggggtccccagtctggcttatgatcatattccagcatagagcactccctaaccccactcccgtagcactgggactatagctttatttcttgcatcatttttctctacgctcaaaaaaaaaaaaaagcaaaaacaaacaaaaaaaatctgctcagcatgagaaatcaagttaatgaaaacgctaccgcattgaatttccaataagagaaaggcaaagcaaaacttgtcaactaaagaaaggggcattcactgtaatcccttcgaggagaggtggaagcaggagtaatacaaaagctcattactgtaatcaaggcatttgtaactgttggtggcaggaggtgaaagagagagagagacagagaggggaagactctgacggaggttttaactgtatgcatgccagtctttcccactcgtcttgctggtacaatctggatcgttcatatagaaaggagacagggtttgccaaacttggctgaccaagccaaaaacactaattagcagcagctgctcaaaattggggatgctcttgccttctagtgcaggggtgatgacttgttctgactcttcaagattcacaaccttagactgcaggatgcactttgccaggggaaatgtattctccaacgtggctgtgtgcattggtgctcaaacattggtgaagccccaagtacttgagagggacaaacaaaacacctgtggaatctcttggtcagctggccagcaggagtttgaagccagggtgaactcaaagcattctcccaaagaagcctttttcaaccagggggcgctgacagaagttgtcaacacgtctggcaaagctttccagcatctgctatgatgtcttaatcctcctgtgaggagtgacagaggtaatgtgtggcatggagccatcagtgacatttggtgattgaatgttgctggtggcagtgtcttaatgatggagacaattgattgataggaggtcaactgccaagcagttaatccgatggcaaattccgctcataatggaagagctggcccatgcatgcaaaccagcatggtgggggattcctgctgatgcagctgtgggcacatgaggagggggaaagatatcaatgcctctgatgaatgtctagcaaagttttccttgtgaaacctcatggaaagttccatgaggccagagatcacatctactttgttcactgttctatcctttgttgctgacacatagtggccattcagtaaacatctgttaaatcgaggaagcagtgaatgagttggaagctgccttccttaggctgttttacttccagaattctactttttcactgacagtaagcctaacctctcaggttagaaatctaagttgccttgcattcctccctctctcttccccaccaagctctgcatattccatctcaggaataaatctctaacatttctcccttgtcttctttctctgaagccaatttgcatctcccaagtagtcttctgatgagtaagcctacccccatctctgttccatggcccccttaagtcatttatatctatctatctatctatctatctatctatctatctatctttgagacagcttctcactccatcatccaggctggtgtacagtggcatgatctcagctccctgcaaactccgcctcccgggttcaagtgattctcgtgtctcagcctcccaagtagctgggatcacaggtgtacaccaccacacctggctaatttttgtgtttttagtagagacaaggtttcaccatgttgagcaggtgaccccaagtgatccacctgcctcggcctcccatagtgctgggattacaggcatgagtcaccgcccctggcttaattcttttaacatgtaagtctcatcatgttacaaccctgctttacatagtcaaagtcaacaagtgttatttggccatagatatctcttaggccatgacaacccacctcctagtaccttcccagccttgggttaacttcatgtcagtgctcacattggtgcttcactgtgtgctgtgtcttacgtttcaaacacccattctgcatcttcttgtttcctaatctttgctcatgtattcactcaggctggacatccaagcttctcttttttttcctagcaaaacactgtctttgtttaagatgtgtcatctggggacctttttctgattcttgtcctcccttggagaaataaatgcatctccctttcctttcttccatttttcatcactttgtacttgaattgtcaatttgtctacccatctcacctgctggcctatgaaggtgtcaagtcaggggccataacatctttttcactgttccttccagcaactaatatggttcctggcacataattacttaatgttagttgaaagaaaaaatggatggatgaatggatggatggatggatgggtagataagtggataggtggatggatgggttggttagcgggttaataagtaatgggttagatgcatgacaaaatgaatggaataagtaattgaatggattcataaactgattcattccaggggaatactaagaaaatagcaactccaccacctcccaccttgggataaatgatatggccctgtccagggaaggctgagtgccctttgtcctcagacagtgaattctggagttccaggtacatgagcatcagggtgtgatctagaaaggagcctgtggacctagttgggcgtattctcttggtcctggggattctttgtgccatggagaagagcatagtttgagggaggtcagaatgggaggccagaacccagctgcttatgtctaaagccattatcttaccaggaaatgactaagacatatgggaaaggaaatgccaatctggtaactcctgtaactgtcagttccagtggaggatgcaccaattgctcgtgctcacatgctaaatcctttctccagacatcaccctggcatggccctccgtctcctagtcaggcattaactaataggggaaatgcaaaatgttgataccgcagaatatagagacagaagagattcacactgaaagtgcaaattactttttttgcagtgaatagaaagtcacattactctaagaagctgcctaattatctgtaattatgcccaaaatagtcaagctagtttgctagccagttgaagaattgcatcttaaatgaatttgtcactaaagaaagaatgttgaaacctggcaaaagagattactgcatttcaggggaaagattagaacatatcatgcctgtgttcagtctttcaaagacgtggttattggctgggcgcagtggctcacacctgtaatccagctctttgggaggccaaggtcggcagatcacaaggtcaggagttcgagaccagcctgaccaatatggtgaaaccctgtctctactaaaatgacaaaaattagccgggagtggtggcacgcacctgtaattccagttattcgggaggctgaggcaggagaatcacttgaacccaggaggcagaggttgcagtgagctgagatcgcgtcactgcaccgtagcctgggcgacagagtgagactccatctcaaaaaaaaaaaaaaaagtgactgtggttattgtaaacatttttgcttaggaagcatttattacagctgttcaatgtagcattttacggtattcggtggaaactctaatgtaagttcggagcagtcctaacattccaagagttaaaattatccatgattgggatgtaatatctaaattgaaataaataaactgtttttatatgaaggattttttcctgattcaaataaaggaatctagtttcattgtaggcaacacaggaaatacaaaagttataaaattcacatctgtaatcccatcaaccagagaaaactcttagtaactagtgggtgtttcttgctagctcttttctatgcatatgtttttcttataacactggaattttaatatatacaacattgtttagttacattcttccatgtaactttcatgagcatttttatctgccctgtaggaatcaaagtgatgggttttttttgttgttgttgtatttttttctcagatggagtatcgctctgtcgcccaggctggagtgctgaggcacggtcttggctcactgcaacctctgcctcttgggttcaagccattttcctgcatcagcctcccaagtagttgggattacaggcacccaccaccacacttggctaatttttgtatttttagtagagatggggtttcataatgttggctaggctggtcttgaactcctgacctcaggtgatccacctgccttggcctcccaaagtgctgggattacaggcgtgagccaccacacccagcccaaagtcatggtttttaaatgccaacataatattcaccatttttacatactgttgtttacttaaccaccaatttattgtagataattttgtgtcttttataggtatttataaacgattctgcagtgaacattcttgtacagatataattgcctgtgtctctgtctgttttcttaataatgcctaggaatggaattactaggtcaaaaggtatgatcattttaggaggttatagattagacctcaatgtagcagtgccatttctgtctgtgaatctttctttctagatctttctaaaccagggtatagaaatagaaggtaaaatcctcttggacagaaaagaaaagaagcagtgaacacttacttaaaaaaaaaataggcaatggaggagagccaaaatttgaactccagcctgaaaatcacaggatccctggagacaggaatatgcactggcaggcaacagaaagccaaacagaaatgagatcgaagaagagataggaaaacaaaacatttcaaaggaggcatagaaaggagcatataatggtgatggaggcaacgataagtaggcaatggaaagtagagaagaaaaatagcagcatggctgtgaaggaagggaacacgaacttctgcaaaagctgtcagaatcaaaatgaagccacttatgttaaaattttttttaattaataatcaatttaaaaccctgaaaaatgagctgaggagggttatgaagaggggagtctcacacttggttgcctgataacaaaaactgtcacaaaagactgcaaaaaccacaaccttgcacaaaggccatcacaaccttacacacacacacgcacacacacaaatacttctgcaaggacatctgcccagcaactgcctgtccaagtacagactgatgtcacccttattattgatctttgtagccagcaataactacttcaaagccattatgtaatcttcctcattttttccttcaaaaacatttgtctttctttacctccctgcacacacatacaaagttactgcagcacatgtattcccattgcaatgccctactgctgaatcttttttttttttttttttttagagaacctctccctctttgttatttaggttgatgcttcctgaggccacccctgtgccacacagacagaaccctgcggggccagaggtggagggtaggagccattgagtgaaaaagcaagtcaacatctaccagcttgcagcccctcactgaccatgttgtatacagagagagcgagctactttggtacttcatcaaccagacagttcagcagcttgaaagaggggagatttttccatgttgcagagtgacaagttgatatacaatgtttatggagaccatggtttgtacagtggtaaactcaagcacagaaacaggcataggggtatcttagaaccttgctgctcaaagtacagtccatggaccagcagcattgaaaacacctggaagatttttagactttcagaaaccaagaccctgcctgccccaggcctgtggaatcatagtttgcagtttaactgattccccaggtgattcatatacacattaaaatttgagaagtgctgtcttaaaagacatctttttatatgaatttcagactttgctggtgcttggatttccagtgttcactggaaaagccgaaagatttatgtgagcacttagttgactgaattgcatgtgattttagaagagggatttccagatgtaaagttaaaacatgatgtgtgatacttagcataagtggagaaaaccaattgataagcccaaggctaagtggaaccattctgactttttgagaaacgcaatctgtttgggggatagtttctaaagttcatcagaagaggtgtcattaaatcagattttaagcagaatatagcagtttggctaatgttggatagtctgtctgctcccaattccagaaagtaaaatattttgcaattgaggattgtaaacatcttagacagttgcaaggactgtacatgacatatccatgcaagagtattccgttctgtttctatcagcttcttatgctttttcaatgggaaatagttttggaataatgggctcattagagatagacaaagctatggcctgggggaagtaacactggtacccagagggttttaactgtttcactccctttcccagtgactcaaactatgcaccagtattaattttaaatgactttacaaaaagacttaatgagataaatcgtgtaggcacagtataaaagttagtctttcatgttgtgtctgcctgcagcagcgttctaactcaaacgttaggagaggcttagagacaatttgggtctagcatcaaatcagataaactatcatttttaattattgttattttgataaggacttcatagtctcttaagtaagccagccctaaaaatccttgctcatgtttttaaatggtaagggagattctgcaaagatagtatgaggaagcaggaggaggaggcaaatactggttaaatgccttgtctaaatccaccacagtcctcagcatcatcatgaacaaattgcagcagttatgcaccaagcaggatgcaaagcaggaaacacacattctcacatgcggtggtcaatcagccaagtaaagccaaagttgttgttgttcccagttcaaagatgaggaaattgaacctcggaggggtcaaataactcatccccaatcacaaagccattaagtggttctgtcaggatttgaatccatagcctaagttcatcaccacattcttctccttgtctcagtttcggtatttctcacaaatcaagggacctggagagaaacagaaactatttccacaacatcaagaatgtcacttagaatcaatattggcctggcttcgataacttacctaacagagaggtaatcttttcatggggcaccccacacttcacgccacacttaggcaagaagaaatgttcacagtctcagctgatgccagggaactttacagcaaaggaaacgttgaagcgcctcctgggctgtgtccctccatccctgtgcctctgtcatcctgtctacagattctcatgacagcaatgacaactctcaaccgattttctacataaggggtccccgacccccaggcctgtaggaaccaggccccacagcaggagaggtgagcagtgggtgagcgaacgaagcttcatctgtgtttacaggcactccccattgctcccattacttcctgagctcctcctcctgtcagatgagtggcagcattagagtctcataggagtatgaaccttattgtcaactgcatgtgagggatctaggttgtacgctagttatgagaatctaatgcctgatagtctgtcacgtctcccatcacccccagatgagaccatctagttgaaggaaaacaagctcaggactcccacagattccacattatggcgagttgtataattatttcattatacattagaatgtaataataatagaaataaagtgcacaataaatgtaatgggcttgactcatcccaaaaccatccccactctggtccgtggaaaaattgccttccacaaaactggtccctcatgctgaaaaggttggggactgatgttctatgtatatgatagaacatgttactgacatgttacattatatgtactattctgtgttgaagcaaacgaagctctctgtaagcctttcggaaatagtacagatacggaaacaggggcatctaaaagtcggccatcaggcactcagggtgacatactctgcttgccctttgttataggaaatgccctggagttgagtctgggaggtactgggaggtgtctcagcaggagataagcagcggggacttgccgtcttcctagatagtactgttacttggttggtacctttcatctcaatgcccatttgtgataccagtttgaccccagtagcacccaatttcagacttccccagccacctgtgacttagagtgagtagagaggcaattagggcacatgcttcgatcattttgagtgacagagtcttccagataaaaacaatataaaagagagactgctaagggtctctggggtgaagggtctatagatccgtcacttccacagggaagattgcttttcttggttgtttgctgagacctggggggcattgagcactgggaaatcaatgattgtacagctttatataaaaagggcacccagcaatgctcacacagtctacagggctcatttcttcctgaggcagaagagttttgctacactgacaagaatccttctggctggacacagtatgtcacctgttgtagaggggctagagtttgagaccatcacatttgctttctgcaagccctgaagatttaagagtgaacctacattgtttattgggatgttcgcaggttgtagtggtaagattggatcagcgcggtaccagttagcagagagggatgatgtttttaaagagtcttccagcagccacaaacatctatgaaagatacttccatcaaaaacaaagcttgaagtcaaaaaaaatggggaatttaagagcatctagatttgtctgttatgtgcaacaacttcttacctgactggttgtgccttgggtagtatcactggtgccttatgcatgaataatgtatgtataatgtatgtgtcactgccttagaataagcaacgtggaccacaggtcttgggcaccttaaataatttatatttaaaatctacatctagtcagagatgcatctgcatctacatgtaacatttatgaatgcaagtggaactttttttcccttttttttcaaaagctaaattgcctgtatttgagtgttagtgttccaattaatttagttgacatcatttcaactttgttggaatacctactacttacagtaagttatgtgggcccttgttatgaattaatgagagcaacagagaaataacttcagggaaagggtacatctttaaataatttacccacgtgggtaggtaggaaaactggatctgtggtcatgcgtagtgtgcgggtatccgaagctgggtgtccacagtcacatcgggtcctctgtatctgtggcacaagggcagacagagaggtcagtgtccaacaccatggaggaccacaggctcacctccctcaatggggtcagcatctcataaattagtcatgctggagccctctccaggagttcctggtgggagctaaagggaaggtgaactcctttcttttaaacactgctatcatgttaagatccactgccaggaactaggagggcagagtgaagacagagaaatgcaaagactgtattctgaaaagttaaggaagcagttctgtgggtgaggatagtgaataataatgttgtgagttgttttgatgagccaggcaatgtgttgatcacttcacatgtagtatggtctttaatttttatttgaaaaactgaaggccagacatggtggttcacacctgtaatcccaacactttgggaggccgaggcaggtggatcacctgaggttgtgagttcaagagcagcctgagcaacatggagaaaccctgtctctactaaaaatatgaaattagctgggcatggtggcgtgtacctataatcccagctactctggaggctgaggtgggagaatcacttgaacctgggagacagaggttgtggtgagccaagatcatgtcattgcactccagcttgggcaacaagagcgaaactgtataaaaagaaagagagagagagagagaaaagaaggaaggaaggaaggaaagaaagagaaagaaaaagagagagagggagggagggagcgagggaaggaaaaattgaaaaccctgaggtaggcaccttaattctacccatttttcaccttaattctaaccactttccagataacaagcacagagtggccaagcaactttcttactgtcacaaagaacagggattggaagccaagaagccgaaggcaccacagcgtctttttgaaacttggtgctttcgtgcctgcccaaattctctgattaagaaagaattagtttcctaattcttttatttttaaaataaaaataaaagattaaatcagatcaaacagttggccaatatacatgttggttattcacacgatggaggcctcattgcctgatacatcccatactgacagtagcagatttggaactcatgaaaccctcatcgcttcaacttcctgcaacaccccagctccttctaatagaacccagtgtctccttaattctttatgtgatgaatacgtattgagtagctactctgtgttagtccctggacaagagcagagcaaaggcaagaacgagataggagaggtctccctctcacagagtttggaatatagtagacatattcatagttctgactgggcaaaattcttctctcttacttttatccatagtttccagctctgaaacctaatgctacaaagataaaagttgcatttgatagataatgcaatggaacactactcagcctttaaaaaggagaaaatcctgccatttgcaacatcatggatgaacctggaggatgttatgctaagtgaaataaggcagactcaaaaggacaaatattgcacgttaccacatatgcagtgaatctaaaatggtcaaactcatggaagctgcatgggaaaatggttgcaggggcttgggggaggggattggtgtggtattagacaacagtacaaagtttcatttatacaagatgagcaactcctaaagacctactatttagagtttcacttaacattgtttctctgtaatgttgatgagaaaacaaaaatggtcattggtccctgggcctccctgctgtgtgctctgccgttgatgttacttagcttctttctctgtattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggccccccccccgccccaggggctgagggttgggcagattaacctggaagggaaagggtatgtctagcaaattagaacaagtaagaagtatgatcacctgtaagttcatgctacattttctggaggtttttcttaattatttaattctcctctcagaccttctgtgactcccaaaccaataaaccatttttgtttggatgttgttcttttcttcccttgaaaaatactcattcaggttcttctctcattccttcaaaagagacttcaggccgggcgcagtggctcacacatataatcccagcactttgggaggctgaggtgggcagttcacctgaggttgggagtttgagaccagcctgaccaacatggagaaatcccatctctactaaaaaaaaaaaattagccaggtgtggtgacgcatgggaggctgaggcaggagaattatttgaacctgagaggcggaggttgtggtgagctgagattgtgccattgcacttcagcctgagcaacaagagggaaacaccatctcaaaaaaaaaaaaaaaaaaaacttcaagcaagggaggctatgctatcaaagtatattttcctcctcttctgcaaggggtctacatttaagtcaatagtagcacaatataagaagaaagactattaccagctaacatttattgagtatttactaggctatcagcactggtctaagcactttacaggttaaattcatgtattttctacaatgatcttaagcagaatttccttcattttcttatttccaaaattatactacctaatatagaaggtgatgatgaattttgagagataatgtacctgaatttcttattgttcatggtatatgcggaataaattgtgcctgctgattgctgtagtggtatcatcaactacaacattgttccacagctgagtggcatcactgttttgtagttccttaaaagagaccactgctctgaatctgactaaactgaagacagagcaccaaaatcaaatggggattcagatgtccaaaggatgggaggtgaatgataaaaatggttagagtcacaaattggaatccagtggagcgatagtgccgcagagtcaagatcctagagagcagaattctgagaaacccatgtccagagaatgtggtcaggaccttggagagctcatggtgatgtccaagtgtcttccacagtttagatctcagactagtgcaaaagtctgcatggggctccagccttgtaagggtctcatcttgttttatttggaggctctgacatagtggaactctgggtgccaaagggatagttcagaacaggaatcttctgacctggatagggcaatcaaattcttgattgtgttagtgcatcaggatccttgtcagataataagaacttttcatcttcctgtgtcagcagagttcagctctactaccagaatagaaaaaaaaattgcaaagtatatagcaaaaaattagcaaacagcaccaacttcttttcttatgtaacccacagtgaacaagaggcaattgtctcaatcggattcaggaacaacactgggttacatttggattctatgtatttttagatgtttaatttctatttgcctatttcatgaaagattggtaatcacacataaatctgcatgagtaagaagagacccatgaaaataaatagtcctacagatgtaagatttgagataaaacatatcttaagtgaatagattgtctttgttcttcatgaaccttcaaccttcatgccacataggtttggtgaagaacgtttttgatgtctgttacccacatggagggtttctgcctgtctattttgggtagaagatacttagaacaaaagtcgtcttgaagggaggagaatatcaagaaataaatcatgtctgtgttcctataaaactaataacaaacttggtaaacatgcatctgaaaaataactagaagtgctattctactgttactataaaggaccctgagtactgtagatttggttaaactgtgggtagccaagagggacgaggacctggattttgtcctgagcttttggcaggctggtagagggacaagtcccctttggataagtccccttttctctctgggtgtgtctcctcatctgtagtagaaggaccattggattagctggtctacaagattcctttcatgatcagaagtacagagtaagtatatgaatgatgcgtgaattaatgaacaaacttctccctgttgcgacattccaggaatagcccatggacttgcaaagagaggcaaaaaatggcatctaccagctgcttcctcttcttaggagtctccaacagagcctaataacatggggaagcattactaaattatgactttgtgcaagattattaactcggagtgaatggctattctttttggagattttaagcagtcatggaaccaggatggactcctgagatggacaactgcatttattcacttcaaacacaacatgataaaaatgtttttgaagctgtaattttacatcctgaaaaaaggttaaatttaaggcaatgtacaaagacaaagaatgactttgagcaaatgcattaatttggtttgagatgttcagaatttaatgttgactaaattggttaatctgaagtcttttgggagtggtgacagttatcctgtccttactgtaatcaatgtgcttgatttggtggaaattttacatatagccttacgaatccttttgactgaagtgcaagtttcctctagaaacgaccagttttaggagggcgtgtgtgtatgtgtgtgtttgtgtaagaacacatactggacaagacttcttgaaaaacagactcagtagtgtcaagcagcatataactctccccaaaccaaagcctcctgccctattttctgcctttcctctgctccctggcagagctgacctaccatctctctcggtaacttggcaccactactatccagaaactgaagtgggatgggtcgttttgtttattccgtgaagttactgtgagtgcacatcctggaatctgagagatccagatctgaatctcagtctcttgtgtcttcacagcctgcctgtatgactgggataaacaaccttaaccattagtttcttcatctgcaaaatggggatgtagtaccttcctcacagagcaattatgagactaaatgaggtcaaatacgtgaaatgattagcaccttgcctggtgttttgcaagtaagtgttcaacatctgagaggcactactagtatcagtagtactgttggtatttatcaggtgccttctgtgtaccaggtaccaggtgaatccccagagatgaaaattggaccgagtctgtattttcaagtagctcaaaatctagcaagaaaaaatggcaggcaagcaagtaatcagggaacaattgggtaagtgaggtgacaataaggcattaacataaacccagacaaggggcagtaaggaggggaggggctgcttcttgaaaaaggtgacatatgggatgactctttttttttttttttttgtttttgttttgagatggagtctcactctgtcacccaggctggagtgcaatggcacaatctcagctcactgcaacctctgcctcccgggttcaagtgattctcctgcctcagtctgctgagtagctggtattacaggcatctgccaccacacccagctaatttttctatttttagtagagatggggtttcaccatgttggccaggctggtctcaaactcctgacctcaggtgatccacctccctcggcctcccaaagtgctgagattataggcatgagccattgcacccagcagggatgaatcttaaaccaagtgacaaaaaggtaagaataatgactgatacattcagggatcagggatagtctgtgcagaggccagagagaagagtatggaggttggagaaaggcagccctcctctgccctggctccagagaccccatgtctgccacagcacaattgtctgagtcctgcagtaaatgctgtaaactgttgttgttggttttgttgttgttgttgttgttttgtttgtttgtttgttgttttcagttagaagcagtgtcattcatacaaatgaaataccaaacaggacccccatggcagaggcaacttctcattttatctcttgctcctcagcgcttttgagtctctccctgcatcacttccctgccctacacctgccaggtctgtgggtcctctttcatgtttgtagttctccaatactcttcaggcccagtgatccttttcagactcttgtcctctagaaaagcaattcagatctcgcccaaggcttacttctcggtttctggctataattgccctcatagtaccctgaccccagactcctactggatgccatccgaaagagttctcgaagccctcatctgcgctataggcacagaccactctccccagccctgacaaccctgacctcacatgcccttgggatttccgttcctcttccactgttctttttttttttttttcttagttgcagagtttttcggaaggactgattaccgagtctcttctttccccaagagtacttctttgtcacaaatgattccactccttgaggacatttggtgacatttaattcatctcctgttctctgcttggatgaattctgggaactccctgagaggaaggacaaggcagtggaacatctgagcaatgcgatctttatgtggtgggtgaaggtgatggattttcatctccttcttcacgttttttcctgctgcatggggacctctgggcattctcctttctcttccttgcttttaactgatttattcttttcaggcttatgacttttcttttgtgataactgatttattattttctgataagttattcttttgtgataactgatttattcttttctggcttctgacttttcttttgtgataactgatttattattttctgataacttattcttttgtgataactgatttattcttttctggcttatgacttttcttttgtgataccagtttgtaaatgtgtaacttgtctgatctttcttctttcagcacccacctctcatgctatagcgtttgcactccattgcatattgtttaagactgggactcatttgagttgtaacgcaggtgtgagaagctttgcaaggctacagaactgtgttcatccgtctcttgacttggactatggaagttgccacctgctcagatgccctgaatggtatgttgggctctaaattggcctgacagtaccacagtcctcttccaatttcttggggatgtccaggcattggataatggcagcccagttgcttctgcttgcagtggaaggaagggttggcatcgttccccagcacccaccatttgctgggaaggaaggactgttcttccctttctttaacttgcacctcaatgcataaagaatatctgccctttccccaacatggggcaggggtggcctgctggaatgggagttccagcttctttctcaatcccttattcactcctgtcataggaagacaagttgctaaatgactgtgggaaaccgaaacacccttccagccacatatactgttagataaggttcctggctctcaaaggcagagccccacctccattctccattctccctcttccactctctccatccaggtgcagcaagccgttttgtgcttcctgttccctggacccgcccaagccctgagcaggcatgggtttaccctccttgtaccatctaatgaggccgggcagagcatcagatgggaggttctggtcactctcaggcaaagccctgctctccagctcactttatgacagcactctgccttcagggttgtcatcacctgttcagataataatctagctcatcatttttcatctgcctggtgttctttgcgtgttgcttccagaggcagaatcccagagaagagagggaactgtcagctcctaagaatcactcctccagaaaagctcagcaaccaagaggaaaaaaaagaagaaacacagtgaaagaggaatgctttccttattcccaccctcatccctcacctattctttctctacttcctcacgttccctccatccctgggagatttaccatctgccattccctgtgtgtcatacagttctaggctctgtgcttctgtcctgcctgtgcctgaaattccttacaattttccccatttgccatccagccaacccctgcttattcaaaactcagattcagcctcccttcttccaggagatccttgactccccagccaggcttagctgccactcttctgggctttcccagtgcccagtcatggctctcatcagtgtattctctaaaaccattgacttcttcgccttccctagcaatctgtgagtctgtagaagaaaaggccatatcaatctaactttgtattcctggttcttggcacatagtgggtgaactcacacagactagagataaatcagagatgaatgagtgcccccttgagtccagggcgtacctgtaaaattgcaaatatctgcatgtacgagttgcaggcagggaaactgagtcacaagaagagttgcttgcataagacttcgctagtaaatggcagagctggtgcatgtgaaaatttctaaggcagaaatatgtacttatttaaaaattttttaaaaagcaagaaattgtctagacaagttttttctttgttcgtctgttgttttttgtttttgtttttgttttgagacagagtctcactctgttgcccaggctggagtgcagtggtgcgatctgggctcgctgcaagctctgcctcctgggttcacgctattctcctgtctcagcctcctgaatagctggcactacaggcgcccgccaccacgcccggctaattttttgtatttttagtagagatggggtttcactgtgttagccaggatggtctcaatctcctgacctcgtgatccacctgcctcggcctcccaaagtgctgggattacaggcatgagccaccacgcccggcctagacacaagttttaaccctgtaaattctgttgcctctaactgcaaccaaagccccaattcatcgcattctgcagagtgctgcccacattcacttggggaatcagcagcatgtacacctcattacttcacctccaaacccagctcacaagcaggcaggatgcgcaccaactgtccggttagcagagcttcccatttaaatcaaattctcttctcctcccaagctcatttcaaaggcattcattggtctgaatacatgtgctggtggaacgaaatgacactcaccccaaaacaaaaggaaaaaaaaaagctgatctgatgtaaaatctgtctgcatttcagagctgtcgagatgaaaaatgaagccacgagtttggcctttaaaaatattaatttcttataaagatgaactggagagtggtaactagaaaattcccttatctcctaggaagaaaacacaggatgaaattctggtccttcttcttgagtcttgtatgtcatttccaaattcaacgattacttgttcacggttcatttatgaggtttctgagcataatgaatgtccgcacatgtcactgagttattgatgaatcattgtttctattctgagctcagttcacgtagttcaatgtgctttggcttggctgtcactttaggagatgatagttaacccaacggagtaaatctggccagttcccgagtgggggcagggggttgggctcaactaagggcaccaacaataaatgcctccttgctggtagatgggaaggactgagaagacagaggggaaattgcttgcattctgctaacatctgcaacgtctgtaacagtgtcttttccagcagttgtaaaggatcctcactctccctttcctccctcagtcccagttcctcctccagagctcctcgtgatcatctcccaaagccactcacttgctgttctgtcctttgaggcctctgtccacttccagctcctgcctctctttcctggaccattgcagagtctcagaactgcctctctgctcccacttccatccattctctcactgcctccagaacattctccttttctgaaacactctcctctgcttgaaagtactgaaggcttcatcttgcctagtgcagcaattccacattccttataatctagtcccaaaccactgtctggcctcctctcctttccctccttctgaacaccctagattcctgccaaatataatgttattccacaaacctatgaggaccttgcctgccctctgtgctttgcacatgctcttcctccagcctttgcactctttccttccctcgtccacctgggagactcctgctgatcttttcagactcagcttaaatgtccccaccaaacctcccctccctctccccattggaaccagctccacactgcactccaccatgttggcatgtacagtacatgtggctaccagttgattgacagattgtccctgtaagccagtctgctcagggctatctctgacaaaatagtgtgttccccttccttggggagtaactttagacaatttgcagtggatactgggctgcagccttgatgctgttttttctctggaaactatgcttgaaatatatttgaatgaataaaataatacatctagtaaaaatacatttttctatttttttctaaaagtatcttacacattttccatcaggctcaattgtgaaatccctccagattcctaattatcttcttcccaagataacaagatttctgtcctctcttcacaaagacataggacatggactcagagacgtccaggcatctaactctctgcctgtctgtctctctggggaagccaatggtttttttgtttttgttttgttttgtttgagatggagtctcactctgtctcccaggctggagtgcagtggtacaatctccgctcactgcaacctctgcctcccgggttcaagtgattctcctgcctcagccttccgagtagctgggactacaggtgcacgccaccatgccaggctaatttttgtatttttaatagagacagggtttcaccatattggccaggttggtctcgaactcctgacctcgtgatcttcctgccttggcctcccaaagtgcttggattacaggagtgagccaccgtgcccagccaggagccagtggttttaaactgatcatcatccattccctttctcagacttaggtccctggtcctgtgtagcccctgttttcttacaaaacaggaagaagctctattgttggccagaaagcaaagcaaaggaacctgagcacacaggattctaactcatgctgttgatttcattagtataggtcttgcatcgtagatgccaaacagagtatccacttaccttggtggccacaaaaccaccttgaggactagcaaaagagccatatggggtcttttctgtctgttcaccccaccttctaaaatccccacctctcacacctggtctctgatgacacttgtctcggatgtgactctgtgtctgccccacaagatgatgtcttcatctgccatttaacccaaccctttctgagttctgatcatgttcctgcaccagggagtgagaatggcaaagccaaggaaaaacgtactgctgccctcaccgtactcatggtctagcgtggaacagcctcgctgctttactgggctgctgtgggaaggaactagcacagtgtatgcaatcactggaaaagacggctggggagctcaacagcaggagacaaagtccatcctagtattcccagagattctttctcatccttttatatatataaaaaaaaatttaaatttattatttatatatttatataaattattatatattttctatatattttataaaaattatatatttatatatatgaataaaatatattttatattttatatttataaatatatatatttataaatataaataaaaatttatatttttatatatataaatataaatatatttatatatttatatttataaatgaaactgtataatttttatataaattaatattatacattcatatatttataactcatccatatatatatatatatatatatataaaaaccttctggcgccacccaagggccagcacctccagctaaacattcaaaagcagaggagctgcattcctctccagcgtgagggaaccacactcaccaaagaaagccaaaacagaccccgttgacatgcacatatttccacaaacatcataaaagtccttttcactttatttcattaccagactatcagggagaatttcccagtggaaatcttcacccaatttgctccatatggattttctaccttattttactactgagaaagcagtctacatgttttatttgcaagagaatcaaaagatggaaaattgtcacatgagggacagtgagaacaggtagctgatagaaatacaattgacagttgcatcctggaagaagctctaacggtcttcatttctctcagcttgatgttgggccaagtttttacttctttaaaagaaaaaaaaactggcccttaaagcaataagatattgatcccttaaattatctgtgtattgaattaggctaacagaatctaagtttaagcaaatttgaaagaatgatcttgaacacgagataacaggccccgagtttgtactcccaggtaatggtgaccatacacttttaccataccagataatcaagaaatattgggtctgccactccttaatgtaacgctggcatgtgccttgagaatccagcacaggcagtttgctcctgaggaggaccaggggtaaagtttattctccctttttccttctcaactgtaattcacccctcaattactccctctcttgtattcccaaactgcattttcttttcgctcatatcctgtggtttgtctcaattctatgcagctaggtgcctgagctagaaactacctaccaaactggtgcctcattcccctggctcctcacatgaaacgtgcactccggccacagaacttagcagtcgctctgcatggggacagatcctggctctgtcatttcctctggactaactaggggaagtcatttaacattctgagcctcagttttgtcatctatgaagtgtgtcagatggtgaggaccatgtcacaggttgcggtgagagtcaaatagggataacttccagaaaactcacaaaggctgacatgtgttaagtgatcagtagatgttatttatttttacagtcatcatcaaaaccctaattgataactaggtattttttattccactttcctgtggtgtgtgtgtgtgtgtgtgtgtgtgtgtgtgtgtgagtttcactattgttgcccaggttggagtgcaatggcgtgatcttagctcattgcaatctctgcctcctgggttcaggcgattctcatgcctcagcctcccgagtagctgggaagagacagggtttcatcatgttggtcaggctggtctcgaactcctgacctcaggtgatctacccatctcggcctcacaaaatgttgggattacaggcacaagccacagacctggccttttgttccactttctaaaactctctttcattcctctgctactctccctcctggaccatctcgtctcacctggatggatatactgtcagtgtcaggttcgcctcttaagtcctcagtactgagcacagtgcctggcaacatatggccccaaaataaatccctgatccattgaattgaatattctagccctcgctcaccagttaattgatgttattcctggccacttccgggacatgggcagaggaaaagctattgaacatgtataatagccaaacatggcattcgtgatttagaagaattcggaacagacccaaaatatgctttggaaactcaaatcatccatcatttctcctataaatttcagtaatcatttctgtttggtttgttttaaggatttgatgcatttaaaatttaaatgtgggaaagttacgccttttgttttatttcctagtagtatgaccaatgaggcaaagaatccaaactcattaagtttcacacataaaggattgaaatgtgtacagtacttacagcgagcacaggctgagtgatgaagctctctttttaggccttgaacacgttgacatacgcaatatttttcatccacagaatatagtaagaacatcatctcacaccatgaaacattaatattggttttatgactgtgcacaatgcagtaacacattgctgagctgccaagaaatttaaagaataaaaaagatttagacactgaaagaaccttgaatcattgaatttggggaggtagggaggaaggttggagtatgcctaggagctgattatgtggcttccaacaagtgaactagagccaaactatgtgtattttaaatgatttggatccttaggtttagtactggtgggtgtggctcagttctgcctagtcaccattcagtggtgggtcaggaagccaatgggttcagcaaaaaaaccggaatgacagtctgtcagcatggaggtgaccactgaacctgtggaaggtaaggaaactactagaggaaggacagtgaccagcacttgtgacacatgctatctcttcccttttttgtacccatagtagacatcactaatcaatggcggcacctttgccctttgagtccagatataaccttgggatcctacttaacaaaggggcctatgcacagttgccataattgatacaatttgccatataaactgaaatgtaacattcctaaaatttttaaaaataaaaaacaaaggtagaaggaagcccaagttttgtcaatgaggctgcatttttaaaatgtaggtaactcttttcttatcacccagtagattctttaatggcaaaaaggccaggcttgcttaactactgtagttctctgtcaaatcactacactcatttatttggtaactattgaacacctgctttgtgacagcaacatacatgctaattggtagctgtcccattattttggcagttctcagttctgagccttgggacagggaagcctggaccatcttgctccagatttcagtaaattgggtccccgggatttaaagaggagatgaggatccccagatacgcttggaggtataaaggtatctccaagccacagttttcccgagacagtccttaagcgccgtgcccctcaattttcccagctgcgaaatgggcagctgctgaaaaagagaccctgcagcattgtcatgaggttcagatgagagagataagtgcctgggtcatagaagatgctctggaaatggcagcagatattgtcattatgctgatgttgctattgtcgtcattattttttgtctcagtgtacacccctgatgcatcggatgggagcaccttgctctccattcttagaaactgtgctcatgcacttgagcttgcctccaaagtctagagcctcaaggtcggcctgattattgacacgtttgactacctagctccaagcagggagagccctccaggccctcagtggtggtgttctcttgaagcctgtgcctcaaaaacactggtgaggaaaagcagctgtgactgcaggctgagaaccaaatacccaggtctggattaggtgtgtcacttacagttgctgctctgagatcagacccaggctcaaatcttggcctcaccacttaccaaccacacacctgtgagtcactgcagctcttgcgtgctcagtgtcctcatttgcatcacagggatggcattccgtgcctgcgattcactatgggtcttaacaaatctattccttctcttcccctcccacttcagtggtagcttcgcgaatcacgaccaagtcataccaggccctgttaagattcccatgtaacaacaactttctatgaaacaagaatttcacatacaacttctggggccaacagggctccagaatttactccctgcaatatccatgaactccagttttaaaactccaacccatgaaaagtaatttctaaagggaacaatgtgaaatacccaagagaaatgaaaacacacatccacagagaaaccatgaacatgaatattaatagcaacattacgataatagctaaaaagtgggaacaacccgaacgcccatccactaatgaattcataaacaaaatgggcctgtccatacaatagaatattatttggccataaaaatgaacgaagcactgtgagatgacgtatttttgttgctgaagccacctggcttgtggaactttgttccggcagccatggaaaatgaaggcagatggtgactgctgatggatatggaatttttctttggggtgatgaaaatgttctaaaatcaattatggtgatggtgatggttggacaactctgtaaatatgctaaaaacaattgaattgtacactttaaataggtggattgtgcactatgtgaattatatctcagaaagctgttacaaaaacaaaaacaaaaacaaaaagtgtcccacactatagccagaataatcttatcaagtcaaccgcctggttaaatcaccaccgcagggatccttttcctctcaggagaccaatctgagcctgtccatagatctgtaagacaagtaccatctgacccatctccatccagcccctgctcacaccacgtgtccctctgtctcggccctccagcccgggggtttccatcttcacccatgcccatcccagggcctttgcacatgctattcatgacctggagtattttttcaccttgctccatcctattgtcctcattacctcttaacctcccgtcagattttagctcaaccatcagtctcttgagaagcttcctggtctctgagagacggtcaagtccttcatggaggtgctttcattgcacccgaacctcttcagctatcatttcaccattagaatttagcataaacttatatgattaatatctgcctcccacactgggctatagtttgtgtaagagcaaggtccaggactatttcactcacctttgtacccccagaaactagcacatagtactctttattgtatttttttaattgatgtaaaattcacataacataaaattaaccacgttaaagtgaacaattcagtggcgtttagtacgttaattgatgtaaaattcacataacatgaaactaaccatgttaaagtgacaagttgagtggcatttagtactttcacgatgttgtgcatccaccacctccagctggtcttaaaatatctttatcatcccaaaaggaaactccagagccattaagtagcctctcccacttcttcctccctgaccccagtccctggctaaaaacaacctcctttctgtctctatggatttatccattctggaccttccatataaatgaactcattcaatctgtgacattttcgtgtctggagtttttcacttagcataatgttttcaaggttcttccatgttgtagcatgcatcagtatttcatccctttttatggctgaataatattttcttgtatgggtggagcacattttgtttatccattcgtctgtttatggacatttggcactgtttctaccttctggctaatgtgctgttctatgaacgtgtgcatacatgtatttctttgagtgcctgtttctaattctttggggtatatatctagaagtagtagctctatgtttaactttttgaggaaccatcatactagcaccatatgtggtattacacatagcagtgataccattttatattctaaccaacagtacacaagaattccagtttctccacatccctcccagcccttgctattttctgttgttgctgttttttatgctagccattctagtgtctatgaggtgccatctcatagttttgacttacatttatgtcatgattagtgatactgaacattttttcatgtgttcattggccatttgtatatcttctttggagaaatgttgattcaagtattttgcctacattttaactatgttgtagagttataaatgttgcctacatcttctggatagtagacccttatcagatgtatgatttgctgaatatttttattccattctgtaagttgtcttttcactttctttataatgtccacttcattgtatttttaaccaactaaataactaataagtccagtgacaggcatttagatgacatttgtgggcaaaacaatcaaggactcccatatgcaattactaatttatagctccctggatacctgggggtcaggaatcagtctgttgattggctgcgggctttcacttccatccaagcatcaggtcacatggtgccgtcatagctgcagactcacttgtgaataatggatgtcttcatataggaagggttaaacagcccctgtcctactgtgtccactgaccaagtccccttcatgatttatggatgatcacattgaaggaagaagagaggaataggagaagatgaggtttcccagcacgtccttttcaggacctccatgtcacgcctcactgccaattaacatttacttgaattcttggttccctccccagcagctgttgggtccagctctctggggatgtctgagatataaatgctcagacctgcacactgacatttaaagagccagtgaggggtctgcattctttatttaacaccttctttctgttgcaatatgaggtcctcccagatgcccctatgggaattactaatggccatcacatcttggttcagggaatggttgtctgcttttaagcaaagcctgagactcatgggtttgtactgcttcccagagggctgaggaggagaaaggggtaggaaggccacatccgtcaccctgtgatggatgcaccttgtgatacatccccctcgaaatcacgtagatgcatccaaaagcccttaaccattatattttgctctgataataaagcttagtcttttatgaccactaaataatacgtgtttactgtaaggaaaggacacaaaggataaaatgaacattgcataactacatcacccagagataattgctgttaatatcttgctgtatataattctcctgctctatttatatattgtaatacataaataccttttccacaaaaatgagagttcactattcatacagttgcataacctgcctttgcttctcaacaatataatagaaacattttccatgtcattaaatattcccctactaagcatttatttttaatgtgggtgcctctggcttaaacagcagcaatcttcagtgctgcaaagagctatgcttggtggatttgaatacattcttctgctcagagtattatgagtttgtttaaatggtacccgggtgaaaatatatcgctggctagccattcctggagcaggaagagtgtctagtcattcttgacttgctcaaatcctgtaaaattaaccatttctcacagccgcgggctacttttctggatgggaaaatttgctgggacttaaggttccagggcacagaccgggcggtcaatccctggcagatctgtagctctgttaaaggagacagggctggttaaaatttaaataaccctggaaggtcccaggctgaaatatgctacagggagacacaaataagagagacgcacaaatgtcatgagtgttcaaaagcagaagaggtcacattccacaggaagcaaaaggggaggagaagcctgagctgacccttcaagggcaggtccagtttggagaggtactaagggcagtaaatattcattcaggcattgactccactgatgtttaatgagcatctattaatactgcatgcccagcagtgcccttgctgtcaaggatatgacaatgaacatacatagatggtctccaacttcaaacaccttacagattggcacaattcagagcaatagttagcacaataggagagactactggatacagtaatattaataactgctcaataaatgtccactattcggtgtcctatgtgtatcatttcattagtgctcacaacaatgcggtgaggcagattctattattctccctatttgcaaactgaggcttagtgaggttaacgtacctaaagtcctatgtgcaggtagttagtagcggagtcaatctttgaacactttccgcctactgagtgtctgttcctgttatgaaaagcattttgcacatttcctcttatttaatccttctgacaaccttgcaaaggcaatgataaaattcccatgtttaaagacagtgttataaacacagagaaagttgtcatttgtccaggcccacagtaagaagtggagcagggctgtacctactgtggcctgaggaccactccatgcccactctacctcactgttaccacctcagtgaggcagagatcctggctggactaggggagagtgaatcaccccagggagagccatcctaaggctgacttcctacactgtcattgtgttagttctcatattcctataaagaaatacctgagactgggcaatatataaagaaaagaggtttaattggctcacagttccacaggctgtacgggaagcatggctagggaggcctcaggaaacttacaattatggcagaaggtgaaggggaagtaggtatgtcttacattgctggagaaggaggaagagagagaagggggaggcactacacacttttaaacaaccagatctcacaagaactcactatcatgagaccagcaagggggaaatccacccccttgatccagtcacctcccaccaggttcctcctcccacattggggattacaattcagcatgagatttgggcggtgacccaaatccaaaccgtatcaatcatttatttcattcacaagtgcgtattcagcacctgtcatccctggagctgtactgatgtgaatggagtcacagcccttgataggctcacaggacacaggaagccaaatgtgccattgtgataagtcagatattatgttaaatgtaggcatgggtataacacagtgtgggggcagaaaactggactcccagttagacagggacaaattagggcaggcttcacaggggagtaacatttgagctgacacttaaactatgagcatgtgcttacctgggagacacctggacggaggctgtcccaggcaaagggaatggcgttttcaaaggctcagaagtagagagagcatggcatgtttggctaactacggccaggaattaagtactgctgatagataatggatgaggggaggagtgggaggaaatgcaggcagagggggacagatctccaagggcctatggtgctgtccacagagtttaaatgttatcctggtagcaacagggagtcatgcaaggttgtagagaagtgtagcagagtgattggcattgagtgtcagcaagatcattttaataaatatgtgcgtgaggtgatgctatggaaccactggggctattttttgtggcctgacttacaggagaggtagtgagaatagaaagaagacaggtgtgagcaaattaaggaggtagaattgatcaacttagtaattgattaaattggtccaggaaggtccaaaatctaagactctaagatcaaggtaactcagcacccagttttcatttctgttcatttctctctctctctctctctctctctctctctctctctctctctctctctctctctctctaagtcaggtcagggtctccatctgccacccaggctatagtgcagtggtatgatctgagtttactgcagcctcaaactcctgagctcaagcaatcctcccaccttagccttccaagtagctgagactacaggcatgcgctaccatgccctggcttatttttatatttctttgtagagacagggttttgctgtgttgcctaggttggtcttgaactcctgagctcaggtgattctgcccgcctcccaaagtgctggtattacaggcctgcaccaccacacccagcctgttcatttctagtaagtccattattttacttcttttatttgttcttattaaagtttccatgctgttggagttaattgtaagtagaaagttgagaacggccaaatgtttggttggttgctgagcagaagagcaatacttagcatctttgttacataacagatctctatttgtgggagttaatatttataaaagaaagaaagatgcattacccatagatggtgccatttattctgtttatttttaaaatgcttttatgttgttaaaatcctagcctttggttttgcatctataatgaaagttgggcagattgtatttcagctggcatggaaggagaagatcttttctcttttacaaaaatcattactgcatttgttcattgatccaacaaatgcacgtgggcatttggaaagcaggtatggtctctgcccttccgaagctgacagttgagtcatttatccctgagtacagcctcagtatttacccctgttttaaacagctactcttccttaaacattgatagaatgtcagaaattagtcatcaagaaccaagggtgactttcagtggttatttaatatttcagacttaaatattcttcccacatgctcctgcctcaagacttttgcacttgctacctcctttttctgaaagtttctcctccaaaatatccacatctcctccttattcctttcatgactttattccagtgaagtcttctcaggccaccctatttaaaacagagccttggccaggcacagtggctcacacctgtaatcccagcactttgggaggccaaggcagtgggttgtttgagtccacgagtttgagaccagcctagtcaacgtggtgaaatcccgtctctacaacaaaatgcaaaaattatccaggcgtaggggtatgcccttgtagtcccagctgctagggagactgaggtgggaggatcacttgagcccaggagttcaaggctgcaatgagccaaaatcatgctattgcactccagcctgggtaacagagcaagaccctgtctcaataaataaataaataaataataaaagaaaactgagtctccaccctagaactttctccctttttatttcatctcctccttagcacataccactgttgatcttctttacaatcattctgctcatccagaatgcaggctctaggatgagggcatctttgtgaccttgtctatggctctgtccacactggctaaaagattgcctggtcctgggtgggtgaatgtttgtggaattaatggatgacccctctctgagccttgagtttctctcctgaacacagggttgtcaggggggtggttagtagggtgtaagggaaaaagagtagcagggtcccaggatccttggctctgtgagggctgctcccagcattttaggctgatcagactacttctgcagggcaatgctgggctggagttggtcttgctttacgcagatgtttctgggttacacaacacttggcttaatccttttttttttccatcaggcccataagacaatttaaaggaatgaaaaaatatgtatgttttaagggtctagacctaatgctagcagcatccctttggagaggttttttttgtttgttttgaggggtcttttgtttgttgagacactgtgcctttcaaaatttaaggtactgccttgttatgcaaatcacacatgtttctagtagaaaaaaaagtaaaagatgtagagaaagcaaagcaggcttcccatggagggataaatggatccttcccagcccacccactgttctgaggctgctgcccataagggttgttaggacacacaggagcctgagtggccaggtctctcaggagtggagacattcacttcccagccgtgggacatttacccaaaccactgcaaagagccacaaatagcataagaccgtgtgctgacggccagtggaaatggagctcagcgttgacagagcttcctgaagactgagctctcttgaaaatgtaaaattgctgaggaccttaagcagagtccgatcaaccgtgttggcccagttggactttcagcctgaactctaagaagcatggtccatccactgagcagaatggccattggtggagtttgcacttaaccatgtttgttaacttcctagggatcctgaaacaaatcaccaccaactagagggcaaacaacaactgaaatttattcagtttattgacaatcctagagccctgaagtccaaaatcaaagtgttggtaggccttgctgtctctcgtggtcccagggaggatcccatctgcttctgccagcatctagaggccccagttccttagtttccagctgcaaagctccagtctctgcttccaccttcaggggcccttctccctgtgtcttctcatcttctgtctcctataaggatacttgtagatttagggcacacccagctaatccaaaatcatctcgtctccagatctttaacttaattacatctgcagagacccatttttccaaataagatcacattcgcaggtactgggggttaggagttggatgtatattttgggcgaccaccattcaacacatacaagcccgtggagatagcactcacttcactttgaggagctatcattcttagttcctttgattttaaagctcatatctctgtccaggatttattgcacatctattctgtagttttaactgtaatagcttccacttgctgattttgttctgtgcaccaggtcacatggtcaacgatgtatagggattatcccattttatcctcataatagtgatggagggaaggtaagattgctttattttgcagaaccaggatgtgtgggcatcaaagagtgtgatttggtggctcacgcctataatcccagcactttgggaggccaaggtgggcagatcacctgaggtcaggagtttgagaccagcctcgtcaacatggtgaaactccatctctactaaaaatactaaaaagaaaaaaaaaagccgggcatggtggcatgagcctctagacctagctactccagaagctgaggcagaagaatcacttgagcccacgagggagaggttgcagtgagctgagatcgcaccacagcactccagcctggatgacagagcaagactctgtctcaaagaaataaataaataaacaaaaatttaaaaaagcagagctgagatttgtatccttattttggcttaaagtccttgctgttttcactatgccataagtgagcaaaagcagagagttaaagcatggtttctggctgggcgcggtggctcacgcctgtaatcccagcactttgggaggccaagatgggcggatcacgaggtcaggagatcaagaccatcttggctaacatggtgaaaccccatctctactaaaaatacaaaaaaaattagccgggcatagtgacaggtgcctgtagtcccaaactaaggaggctgaggcaggagaatggcgtgaacccaggaggcggagcttgcagtgagctgagatcgtgccactgcactccagcccgggcaatagagcaagactgcatctcaaaaatttttaaaaaatgcatggtttttgcttccaagcacctcataagcagagaggaagggacagagaactatctatggtttattgggacacgatgtaatatatgctacaagggaactgtgtcaagagctctgcagtctttctaccctggaaattttagtaaaggcttcaaagagaaagtgacccctgaggcggtcatttgggaacagcaggacttggctgcgtctgaatgtagagaattgcattctgggcaaagggaacagcatctgtgaagaaaggcaaaagtgagtggaccacccacatgatccctcgatagtgtccaggagcttctgtaggatgtagtgttatgatgctgagacactgtattaggctattcttgcattactacaaagaaatacctgagactgggtaatttataaagaaaacaggtttaattggcccatggttctgcaggttgtacaggaagcatggtgccaggcatctgcattgcttctgatgaggcctcagaaagcttacaatcacggcagagggcaaagcgggagtgggcacgtcacatggcaaaaacagaagcaagagatagggggaggtgccaaatttaaacaaccaggtcttaggagaactcactcactactgtgggggtggcaccaatgaaagctctgccccaagatccaaacacctcccaccaggccccacctccaacactgggggttacaattcaacatgagatttggtggggacacatatccaaaccgtatcagatgctcccgagccatgacttagatttgaattgctgcagacacgtgtctctggtggcttcctgtgtgccataccctaagctggcgtgggtggccttcccttcctgaacagcgtgatgctggtaacctgggacctccttccaccttcctgcactctataactacttcccagatcactccgaatttatatttgccatctcaggatatggcaaagtaagacacaacagtaacccaaactaaggcaagggcagtggggatgaggaggttggagtcgtgtgagagtctgtttggagaaggaaatcagtgatactctgttcagtgggtgtgggagaggaggcttgacacgagggggccccagttttgatgcatctaccagaacagggaaggactgtgcttggctggggagctgctgagcttgctttgggccatgctgtgtttgcagtgctcgtgacacattcagctggaaatgttgaacaagcagttagaagtgtagatctgggaattaggagacagttggtaatggaagctgtcagagtccacaggggtgggtggaaccaaagctggaggaataagcaggatatccaagaagaaggctgaccattagagactcggtggagattgcttaaagagctgccaggagtggcaacctaccaaaaaaaaaacttatcattctcccagcccaacccatacagggctcgtggaaagagctgggaaatgggctcccacgtggaatctttggactagtaccaacaggggttttggctactggggaggtgaagaatagtactgtgtatgccccagggtgtagcagttgagagtataaggtacagacccaagaggttgggtttctatcccagtgccaccacataggagctatgtgtcccaggacaaaagaatcctcaactgcacaatgaacacagcaaccacagcaacttcacaggggtatgttgaagaccaactaaggtaacccacctaaagggttgaatactatttccaacatgtagtaagtgctctgtgcacgtagccatgattattataatgacagcgtgtctgagtggagcccggatgaactggcaagcgatgaccacctgtggactgcagcgggaaggtccgcagcctggggctagaaccacaagggagcgtgatgcacacaggtgtgcttgcacccacggctgaggtttttcttcccaccggcacagggcgctgaggcagggatttcctcccagagagagggcggttgagttcagttcccctccactttgaaaatggctctggaggaggggcggaggaaaggcagagactccgtttattgttatttttaaaaataaaatgaaaaggagccctccaagggcttgtttatgggttttattattggcgaagaagagcacacttgtctttatcaacatcctgtctgtctgggagtctgagccgagaagggcaagaccaaatgttaagtcgtaacatctgacttgttgttccttgctctgctaacgatccaggctgttaagaggcttagcccttgtcagcagagccaatacaatttcaagaacaaaatgactgctggagcccagatcagaaaagggctgcctcgtgggagcaggtcagggcagtctattaggcatcttgtgcaaataatgctgaagaaaggtggtcagagaagctgactgtaccaggcataaaatcacggggggagccttccagaataatctgtggccgggttatgctcactgctttttctccctggtccacgaattagcttttggacaacagctgtggtgtaactggaatccatcttgtgtgattttttttccctcagatgatttagaattagttcaatttattttcaaaaagtataacccaatgacagcagaaaggccatgtctcaaattgctttcctgtccatggctagagtgggtgggtgtcatttgctgatttattactctctccgtgggctcctttcgtttctaaagccacctggaattatggccagcaatagaactctaaaccaaagtcagctttgcacgaaaatgcatttgacttaagagaccacggaaaatgctgattaaaagtaaccctgcatggcaaaatttgattaggagatcacatctgaatgggaacaggttcgagggaacggaggatgaatcaggctcagcaaagccaactttgattgcgcttttctaaggggaggatgtggtgctgattaaacgtctgaaattagtgggcagggaccattaacatgcaaaggactgatattaggcaaaggttgtaaagctggaatggctgcaagtcgtagacatttaaaacctagttttagaaacatccaccgacccctcggtgagctcctgtgcttctgtcactgggagtcagtaattgaattttctggacgttttgaccagtatgtaactgtgtggagccgattacacagcagaacgcaatttttagcctgaccttaaaagcattaccttctgctgcgtgattagaaaacatacagagagtgccgcccttctaactgcacttgatttggggaagaagaaagaaaaagaatcaccttgctattttatgaaacctggtaagattcatttagattccacacagatcatttaataacagattttgtaaaatcttaacatacggagccaccataaaacgtattatcttttattacccatacagagaatgacattttagatggtaataaattgaaacccaaggaaagctatttgctttcggagagtgcttggcgaatgacaggaatagcagtttcccaattttacacggtggcaaatatggccccccagggtcattggagccagcccccagctggctttgttgagatttatctgagcaacattctcttatacctcttttttttttttttgaaagatcatttccgtccaaacctcaccacatgaggacccagttgtcataccataacatccctccttccatcccgtacacctggagatgtgtggctggcctagggctgagcctggggctgggaccagccagtggggcatctgcctcaaggtggaaaagagcccagcccatcagctccaaagcagccacagcctccctctgcatagacacctctccaaaggagaaggaccttccctgcacactcttggacagccaaagcctcatcaccctgccacgccccgcaaaaccaggctttctagagactgattcagcctgtctaacattgcccatgcctgcctttggacctgtaacatctgcagaccatgagagcaacctgaggccaaatttgctgtgtggtgatcaacataaccgtttcttgatttactcattcattgaacatttactgagagtgactgagagtgaactagtttgtgtgatttttcccccaggagatttagaataagttcaacttgttttcaaagactataacccgatgaccacatacaggcagtgtcttgggacctcagtgtctcaaggggcaaggcactggggctatggcaggaataagttaaagacagaatccttgccctcaccaagggctgtaataaatacttagaaagtgactgacacattggaaaccacaggcaccaaagggaagcttctccggtacttgatatttaccactttgtagatggcaggacattcatcttcccactagacagattttgaaggaaaaggtctggttgacatcacacttcaaaggattgaaatggaaatattttccagagaaatgacagaggatgtcatcctgggaaggcaggccccctgggaagctggcaggtgggcgaggaatgaggtgcggctggtgaggccacgcaccacgtggagccaggaggctgctgggcgtctcagtgttccaggaaactcagcggtcaccccccagagaaggtgtactcgtttcctgtggcttccataacaaatgaccacaaaatccgtggcagacagcagcacaatatattatcctacagagctagaagtcagaagtccaaaataagtctcactgggccaaaaccgaggtgtcagcaggtctggattatttgtgagggctccaagggagaatccattttcttgctttttctatcttctaaaggcccctggaattccttggctcatagcctcttcctccatcttaaggccaacagtgtaatgtctctcctcgtctccctgtctccccatccccctccctcttctctctctttccccttattctttctccctttcccccccccggacccctctccctcccttcttcccctctccccctccctctttctctctgtctccctccctcctccctcccttgccctctccctctcccccaacaccatcttctctgcttccatcacccatctactcccgctgacactgatgtttctgcctccctctcatgaggactctcgtgatcacattgggcccattcagttttccagggtggtctccccatttcaagatccttaacaaagcctcttgtgccacctaaggtaaaatattcacagattccaggaattagaacatggccatctttgatagatgtttttctgtgtgccatagaagatacgagagcttctagatccaaaagcctggtggcatttagagctcacttccactgtgctcgatacatgaacctgacattgagcatctcacagcataatcacaggacggacgtgtgaagggaaaattgctatacagtgtcattatctcaaccaagagagaaacactcaccgtgccatacagccagggctaatgcagggaaggcaggagtgactctgggaagacaaaccttcatgatggaggcaaccttcaagcaagtgattgtttgattatcacttgcttgaagtgattatcttccaaaggataagtgattgtttcctggggcttaggaggtgggggcgggaaatgtgcagggagggcagagggtacagcataagccaagctgcagagatgcggaggagtgaaaaagcctaagaaggtatgaattacaaatagctcagctttacagaatataacactgagtgaggagaacaaacagatgaggccatgaagagtttgtctttcatgcttgaaaaactcagacattatcctgtagccactgaagggttttaaggagagtccttggtcagatggtagctggacagttcgctctggctggctttggggtggagaggggcatagaagaaggcagggggaccaacctggaagctgttgcataagtcaaggaagaagagatggggacttgacatcatgtgcacacagaggtggtggagaaaagaggacagactcgagaggaaggggaggtaaaatcaggagcactggatgagcagttgtttgaggtaagagagagggaattgctacagagactcccaggggccggctggagatgatccctccgggaagaacggccaggttgtggggaagatgggttctgatattggcccatggaggataagggagagcatctagtggagacatccataacaagattgaaagcaggcgagatgctgtttggtgtcttagagagagtctgttttttctcgaaatggacgtaaaaaaaaagaaagtttcaaagagaacttttggaaaactatgattttcatttttcatttaaattgcatcataaatgggtgagttttaaagtaaaacatctaagggtacatcttgacctgcattgagtcatacattcattcagaacaatgctaaccgaagtgtgcccctaaatcgacgacatcagcgtctccaagaaacttgtgagaaattcagatgctttggccctgccctgaaccttctgaatcataaatgctgcaggtgggctgtcaatctgtgttttagtacacccaccaggggattcttttttttttttttttttttttttgagagggagtttcgctctcgttgcccaggctggagtgcagtggcgtgatcttagcacaccgcaatctccaccttctggtttcaagtgatcctcctgcctcagcctcccgagtagttgggattacaggcacctgccaccacacccagctaatttttgtatgtttagtagagatgggggttcaccaggttggccatgctggtcttgaactcctgacttcatgatccacctgcctcttcctcccaaagtgctgggattacaggcatgagccaccgcacccagctggacaagcactttcaagaagcagtgactctgactctatgtcttacgtacctgctatgtaccaggcataatgttgctatgtcagggcccaggtctagaaaacaaaagctaatgtggcaaatagtacttgagcatctcaattactttttattttacttcagtgttacaatctgtacttccttgtctgaatctaacagattagcctgttctgttctgctcctaaccagccatgtgctcctgggattcactctgtttcctctcactgtgagttccttgaaggtagggcaggacgagaaggcctcgaaggtacttttgagaacttgtgtctcttcacctcacaaaccttgactccaggcacgctggtggccctgttgcagcctgatgtctccactcttattcccaggcccttcttccttctctgaattctctcccctcacacccatccttcaaagctcagctgcagtcttacattaacctgaagccactgaaaagccaccgaagcactcccagttagtagacagctaacttagcacaggctgcctgctgccctggggagccacttatatatcttttatcttcacccaagccgtggcttccttgaaggtcgagagcgtactttttcttgtccctttggtgtcctgaacagaaccagaatcagccttcccttcttattcaatgactacttttaatagagtttagggattaaaggtctcccaccttcttccatataatttgactttcagtccaagacaccatctctaatcctatggtagggtatgcccttctgcaggaatcactgcttaatctcttccggcctccacctctccacctataatgtctaagtcaactgtcccctcctttgtaattccacagaactctgtgcttaccccatctcattgtgctgagctcatcagggtgttggtctctcccacgggacttgattcctgttacttcttcgcaccatcccgcacaatgcctagcacacagtaagtgctcaatcaatgtctgatgaattaaataagctccatatagctttcctgagcaccccacattctgacccccttcatgtaaaccttaattggtattaataccattctgataacacttatctcatctgaccttacgtacttgccttttgttcatctctctggaccagaaatgcaccaaaagcagagtctgtatcatttatcacatcctagcagttatttgagcctaatagacactaaataaatgtttcagtgaactcacactgaatgtcaagtatttgccaccttgagcctacaggagatgctttttccaggggttctaggaacgccattggcagtttatttactgtaactcatcagtggcagcagaagatgcacacattgcctggaaatgttttatttgattttggtgtccctcaaccgcaaatctatcatttaggctattccagccacatatgtctaagagacagtgtttatttcccctgctgcttctccaccctgccagctttgtcgcagccagtaaatctggagaaatgagcgctgccttctccttgcccaccagcccccagccacgaatgcaaaaataaataaataaaaaataaaaaacagcaggtgacagccaagaatgtgaatgttcacattcgtaccaagaggtaaggtgaaaagaggcctaaagacaaacacaagtcaaaccaggctcaccctgctgcctgggaagatggaagaacatcgctcgacctctgcagtgggaataaggcacattttatgaggatgtgtaagcggttcctgctggatttatggactacctattcccagtgttatgtggccagagtggttaaatcaaactccagacagacaacaactcgttctgcttcagatagtgttttcaccaatcttttgcaatatttatagactaggtgtcaggtgcagccagcccggggaagaatgtggtccctgtttaggcttcatattgcaaggacgcttgtgatgcccagctgatcgggacaaagctaaagaggaaacgaatgaatgaattccattacatctttgctatgtagctcatgttaatgtttctcattaacgataccttaaatgttagactagaaagggatttgctaacaaaaatgccttcttacagccttccttgactcctagagcagcatgtgtgtgctggagcccattctcactggctcacaatagccaactggtgtctctgtttccaactaagtgcttttggagtggaatcatctgggtagcttgaaatcagctatggtaggagtagttaaaccaccaaaattgacaacagtacaaatcaggagaatctgttcttaaacagctacaggtataccactctattcattattttttatatattatatataattgtatatttatgtaatagtgtataaacatacagtatataaaacatgttatttgtcctgtaataattgtaatcaatattatgcaataatatgtaatcatatttatgtaatagtgggctaattgtgttataatatgactaattgttacatagctatgatgtcccaggcagtgaattttatctcccaggcagagacataaagcctctaaacaagaaaaggcccctgatctcaagaagctcggattgtcatagccacgatagccactaaacaagtaatcagtaaacaagcacattatagactgtggtagtggtaggtgctggggaaaacggtactcattatctattgctgcatgaaaaattgtctcaaaacttagtgacttgagacaagaagcactgattatctcacagtttccctgctcaggaatctgggcatttcttagctatactctgtgcttaatgggcactcacagagctacaagcaatgtgttcagaatctgctgtcttgctggaagatttgtctaaggaaggctccacttccaagttcactcagtggctgttggcagcatggttggcaattgcttttggctcttcctgaaggccaccctcagtttcttgttacatcttcgaaagacttcccaaaaattctactaaataatagcagtagcatctctccagcatttacatatgccaagctctgtattcagcactttacctcttttaattctcacgtatcctataaggattattctcccccactttacagatgaggaaatggaggcagtgagaacataagcaacttggctgggatcactcagctactaagtcatggagccagggtgataataattgatcacatattgattgactccttcttaaatgtcaaccatcctattgtgcaccaaggtccctgccttcgtggagcctctgtgctgtgaataatgaccatcagcaaaggagcaggaattcacctggagcaagaactagaggtgaaacattcgatatggaaaaagtggggtaccatggaaagaaattcggtctagacaaactgtaaagagagatgtagagtgcagttcaagaccaggcgagagagagatggggtactgtgtgggttaatgggaaaacctttttccacatcacatctatttgttgattttccccccacagctaccactatgcttgttattagtgataaatgttctgttaaatgcatacctgtgtggaagtcattgtagctgtgcaaaacgtcgagggtctggtgatggattaagtgccagatttaatgacatggcttgattcttttttcaagatgagatgtttgcttttcaaatcagtgtgatcagtgaacctggcctgtgtctgtggagattcactcgaggctttttcttgcagacataccatcttgcttttgtttctagaatatatattagctggtagctagttgacacccaggaggagacagcaaatgcaatagaaatgcatgactgcagaactcaaaccaggagagcagcttgactctcttagatatgtcttacaaatcagatagcttcaaataaaatcagaggagccaatttaagttttccagttttgacacagtgcatttcttcctccaaataaaattctatctccttgagctgcagttccgcaaagtataagtcattccctgagaataaatgactttgctttggaaatgccactgatatgctcagacctttgagacataatttagttcagggaaacagtaatatatcatcattatcaataatgaaagtaaatcgcccaccttgtgtgctgactactggctaggtgttgcagccaaaggcatggtccttgcccttgaaaactttgtcatccacttagggagatagtaaatgggcattcaaaataaagcaaaatgggacacatagccttcatattaaacaaggtaagctaagcacagtcataagcagcccttaaacctaaaaaatggcttatgtcttgctcacatcacagtctaaagcaggtcaccaaaggggctttgagctatatagtcatttggagatccaggtttcttccttttgaggaaatagaaagtgtgagaggttacatgggaggtttaagaaccacaccaagtacataacttctgctcacgttccactgaccgcaatcagccacacaagtccatttgactgcaaggacgcctgagctgtacagtctagccctatgcccctggaacccaaggaaataggatccagtgaacatacaacattgttttcaccacaagttcctttgcttgcaagtaactgaaactcattcaggctggttttggtacctaaaaggagctcttgagtatacagtggaatgagttacagaatcaacgaaagcgttgaagtcaggggccatcaaagctccagtccttggcagccaagctgcttcttcccggcagagcagcaccttttgcaaaattcagctcaaaagctgtttggagttgcagttgattacattcgtctttcctctgagccttgaaccaaagaaacacagaatcaggtgaggcccagggagaatacaacttgatcttgagaatggggttgaccttgataatggggcccccttctcactgatgagttcactcacctagtgacagggcagctggacaagtgaaagtgaacctggacaagtgaagaggcaggttgccttcctcatgggcagagagaagcacaagggtggtgagtttcctcccaaaacattcaaggcaaaaatccctctattggtcctaggagttcggggtttaccctacattcctgttttcctgactctcagtcccacatttcctcttttcagaatccagttgtcccagcttgaattagggagttacctgtgaatttagtcaattcttggcaagagagacaaacatgacaagtggccactgggatctctttctctgcatcaaaatttcctcctggagaaagggcatctgtgggctggacacctaaagagcatctcttccagcagagtaacaaatgcagagtggccagcgagggatacagaattaaaaatacatgtgtatatttcaagtaagagtgactccgagagctaggaaattagggggtgactttctggaaaaggctctgaggatcgggaagtaggtcagaggcaagtggaaggtattctgatcatgtatgagcaagggagttcatgtggcattttctctaattttcaagtgcaaactgggtgttgtacattccaaaggaggttactttcattatcggttttggggattttgttactgttctccttgtgaaagcaataatgttcattacagaaaaatccccaaatcataacaggccaataaactttttatattagaattgcttttaaaagtgaaaacttgggcagggcacggtgtctcatgcctataatctcagcacttggggagcctgtggtgggaggatcacttgagcccaggagttcaagaccagcctgggcaatacagggagaccctgtctctacaaaaaatacaaaaattagccaggtgtggtggcacatgcctgtggtcttagctacttggggtgctaagttgggaggatctcttgagcctgggaggtcgaggctgcagtgagctgtgatcatgccactgcactccagcctgggtgacagagcaagaccctgactcacacacacacacacacaaaaagtagaaacttagaagcaacccaaatgttcatccagtagggattgactaaataaattatagtggatctgtacattggactattagacagctgttaaaatgaacagctctgtaaacactgagataaaagtgatatggtaaaacaaattgtgtcgctatgtaaacagtattactttgatgaaatgtgtgtgtatataaatgtgtatattaaatatgtgggtatttaaaatgtacctccgtgtgtgtccacttgtataggaaaaaggagataactatcaatatttacctctcacaggtggggttgggcaagggtggaggagagttctttgaaatgactgttttatttttatgttgcttacaataattggatattacttcagtactaaaaatatttttaaggtcagccttaagtttgccagaaaatttagacttttgaaacctcatcacaaactttgcagtttatctacataacagtctaattgattctctactaggttaatcagtctatttctcattataggtgcaaagttttatttacttcaggagatagaaattggttcattttctaaaattatttataaaatttgttgaactacgagagttatgccaatgtatccttcccttgtgctaccgtaagaatttgtacatacctctgctaagctttgatttattttattgcactcatatgtgaatatgactgtcctcaacgctaaactttgacctctttggagaaagagacttgttttttgatcactgtatctctagtatccaacacgacatttagacaagaagttcattaactgccaattaaatagatgcataaactagttaaagaaagaattagaccaggtgcagtggctcatgcctataatcacagcactttgggaggccaaggtgggcaaattgcttgagctaaggagttcaggaccagcctgggcaacatggagagaccctgtctctacaaaattacaaaaattagctgggtgtggtggcgtgtgattatagtcccagctactcaggaggctggagtgagaggattgtttgagccaggaaaatagaggctgcagtgaaccatgaccacatcactgcactccagcctgaacgacagagtgagaccctgtctcaaaataaataaatatttttaaatagataattacagtaactttccctggctacaaaaaattttctgtttaagggaaagtattaaaagagaaaacgatgtattcataaaatgataggaatactgttttgaagaacctattttgatgctattgtatggtgtgatagctcctatgctttcttgctaatcagagaattgatcatagtgttattgcaatagttgcaatattagtcaaaactgccttattcctacctacggaacatctgaatcaagtgtcttgaggaaagccaaaatgtattagctcatagaattcacaaaatctaaggaataaattctggcttcaaggatgacaactcatccttgaatgatgattaacaacaacaacaacaaactccatctctacctcttagtctgtgtttccttcattctcaggttgactttctttgtgtggttacaggtggccactactagctccagatggatgccctaaccacctccaagtttaacagaaagataacttcctttccctaagcgttctgaaagaactaaaggacaatgtcctggaattgaatttcactcccagggtggactcacttaggttatgtcctcatcgcatgatgataggaatggaaagccctgattggccaggcctgaaccatatgaccatccctagatcaggagtggggtcagccccacccacctgaactgtacctgtactgagggtgaggaaggggtgatgcccgagggaattataacataggtaccagaagaagagggagtgggtatcaggacagttaagcagcatactcctgctatagttagtgcttgaggcagtcctgtagcacatccccacagcaatctgtactggaagttgaagaatgaatgctatgagaactttatctccttcttatgccaccatcatagagtcaccctagtctcccaatttgcttcaccgcgcaatgtcaggagctgtcctttagagaccagccctgtctgagatcaaaagctaaacattctcgtaggactggtataaaagttagtaacatcctcttggataaaaacattgaaatatgaataaaaagcctgaaaacattcatactctttatcctagtaattccacatcttgggatctatcagtcaaaaacaaaccaaaaaaatttttaaaaagcagccaaaatgtatataagccttcatgaataaagatgttaattgcactgttatttaaaattgtcaacattttgaaaaccacaaataaccaaaaggcctaataatagaagacaagtaaattataaaatatacatatgattatattgtaggcaacccttaaaataacatctaggaattatattggtaaatattatatgtgaaaaataatatgatatttaccataatctcttcaatattgggggagaatccacataattttttgtcagtaattgtgtgctttcaaaaataagtaacaatgttttatgacaaaagtgaaagcgttatgcaagaaattagacctgtgctgtccagggtagtggttcacatgttcagagacactcgggaaagattttaaaggtagccaatttactggtttcatatggtccagctgcagaaattatagccaatagtacatgcagtccagctcgtcagtgatgacaagcagaaagccacttccattaggctcaagttttccagcttcagcctgagaatagatgggatttcaagcatctataccgagagatgccaacgaaaccagccaggagcaaaattaccagaattcttgaaccaggcagaaccagggcagatggcatctcaagcaccttcgcagaccagcgccggctgacccagccagaactggaactgggtacggtgtcaattccacttgtactcagcagtcagagaaccgtgtgaccttcgatcctggcggagctggaattgaaaccgaaacatgaggcgtagagccatcacaggagcacactaacttcccactcatcaccgtgaattgaagtggagggccttaacaaaccacccagcagaaccaggactccttaaaatagtagctcagaaaccactcagaagttaaaggaacagcaatgaatggtgtccctatgagcagacagccagttgcacttcaaaatacttaaaagtttttgagagagctagcgttgagctattgaaatttaccatgtaaacttaggacttcagaagaaaattggacatcctccattgcttttttgttccttgcttcctgtggtatttcttaattattggttggtataaccagctgtttttgaagctgtcatactggtaggactatttatgtgattgtaaacacctattatttttgttactaaaggtagttcaactcggactctctgtgtgatgattaagaaatctgtccaacgtgagttaagcaaataagggaaattattgccttcattagctgaaaagttcacaggcgggtctggcttcaggagtggcatgatgaagcggctccagtacaaccactaagaaccatttcttttctgagattccagtataattaattctcttaggatattgcctttgttcttggatgcagggtcttcttctgcattacccctcctgtggtcatgagatgactcctctagctccccctgccaaatgcttccaggtccacaccacagggaaacagaacttccttcacctaactgtcaaacacagggcctggacttaacattatatcactggaataagatgcactgactgacttcttctaattaggactcattccaaaagttcaatcggtaggagatagagaaaggcaatcctaacccaaaccacatgagcagagaagaagtaaaggataggtccccaaaggaaatgcggggtgctgccttaccagatgaatggtatgattgtggaccaattcaagcagaaacctactaccaaagataatttaaatataggggctgttatttaccaatgactgcactcttcttcatcttaggatcagggctatttggctagttgttttgagtatataaacatgatagccaaatctttgtcaaatattgagatgaaaaacacttatgtgaagagagagaatagtgcaatattgcttgtgttaagtttatcaaatcattattggattaaatgcgtcttccacatgtgacagcctgtgcgacaaaaaagacatgaaagaagtgtggtataagtgactctaaacttcagtggggtttcttccccatctgtaaaatgggaacaatgattgcaagttgagctgcttgttgaaaagattaacaaggatttctataaagtgaggtaatgcaatgcctgcctcatcagattttcagtaaatgtgagttcctaaagctgccatctttgtcctaagctcatcatcaaaggtaacctcattttcagatcagcttcctgaggtctctgaaatagcagatatggatgtaaacattaaaggacaacgtaggggccgggcgtggtggctcacacctgtaatcccagcactttgggaggctgaggcaggcagatcacgaggtcaggagttcaagaccagcctgaccagcatggtgataccctgtccctactaaaagtacaaatattagccaggcatggtgatgggcgcctgtaatcccagctactcaggaggctgaggcaggagaatcgctggaacccgggaggcggaggttgcagtgagccgagattgcgccactgtactctagagagtgagactctgtctcaaaaaaaaaaaaaaagaacaacaacaaaaaaaaaaaaaaaaaaaaaaaaaaaaaaaaaaaacccaaaggacaatgtatacccaagcccaggaaatggaacattctgtgatatatcaaatgtctccctaaaaaagaacagtaaatatattgtccccatggcaaactccagtctttgaatagtgactgtcttatattgaagagattccaaaggcacatttatacacaataggtaaaaatgttatcactctttaaagatgcctaccctagatggaggagggggagagacagctccagcaacacgcctgccacctttccaaagcagtaacccaaatctaaatgtcatattatttctttgtgcttgtgctttgtagactctggaaaatcccaagtatgaactgatcatcgaggctcaagatatggctggactggatgttggattaacaggcacggccacagccacgatcatgatcgatgacaaaaatgatcactcaccaaaattcaccaagaaagaggtaaacccctgtgccaaacaccaaccaccactgtggtcacagctacaattactgattgatgttaattcacgtaccacagcacctgctggcccccctttcaaaatcaaaatactcctttgtgggagagacgatggtgttttgctggaattctttctcacatttttattttgtgtttgtgtgtgaggctaaaatactagagcacggtgagaacaagagcactgaatcttgttaaagtccataagaaaataacttttaatgcccaagtgccattttcatagttttattgctgttatttagcagtgagttatgagagtcccactgtgattttagcataacaataactatttttttccagcaagtgcagattgagaggccagacggaacagtagcaaggaggtaaagcagatttcctagtccataacaatgtggcccaggagcttataaataacaacaaagttagctcatccaggagagccattattcattctcagtccctgtgcttttatgattatggatcatggttgttgtttcccatttattccaagggagcgatgtttggggaagggctgagtacacaagatcacattcagttgctaaatttgtacccaaaccaggaagccatttgcactaagcacattctgatggaaatgtgctaagattgtggcttctttaggggcctgggccagggcatggatttgatgcccttcttactgaccaagtgaagaatatggaataggtacgatggcccctgacttttgcagagtctttactgtatctaccatggtgtctccccctgagatctgttgcctgatttgactgtgtgagcctggctttaccattttacaaatgagcttactgtgatgctcagagaatccagagaacaagctccaaggtcatggacagaaaaagtggcagaaacaggaagtgaaccaggttcctgtgattcaaaagctgcagtcctaactgtgatgctgtgctttcctcatctgccatcaatgcttccaacctccagggtgtttggagaaaaaaacctatatagggacctgcagttgccccactgctctctggaggaatctcaaggctacccagggtggcttgagacagatggatcctctcaacccccgagttccccaatggcctctgtattagttcattctcacactgctataaagaactacctaagactgggtaatttacaaagaaaagaggtttaattggctcatgattctgcaagctgtacagggatcctggctggggagacctcaggaaacattcagtcatggcagaaggcaaaagaggaagccagcacatcttcacatggaagagtaggagagagagagcaaaggggaaggtgccacacacttttaagcaaccagatctcatgagaattttatcatgagacagcactaggggggtgggtgctaaactattagaaagcactcccgtgatccagtcacctcccaccaggccccaactacaacactgggaattataattcaacatgagatttgggtggggatgcagaaccaagccacatcagcctcttcacctcggcatccccctgcatggctcactcaggaggtagacgtccccctttctccctgtggtgtcttgggcactcaggattccaacctcaaaacagcaaagtccacgggagcttgatttgctccattctctgacttcccatggcagggttcctctagctgctaatacagactgctcactcttgccatggttccaaactggcatttcaagaacaccagttctaattagttccaaacaattctaattcacttccaagaaattagtcacaaaaattacaccaccggggtggggataggaatgaaaaaaatatacttcagggtcaagtagatgtgggaaacactgaattgattacttttaaatggtttatttaactgcaggatttctgattaactttaaaatgctttgtgtttctctaacagggttaggtatggtctgtggggtttctcattcttctttggcctgggggcttttttttctaggctaccttatatggcttatggagctggtgtttcatggaatgttcactgggggatttttgtttatctttataatttcttttcaacctatttcaaaataaaaactcagagcacattgtaatattcaatataaacttaacgatgggaacaaaaataggataaccccaacccaaaatatgaagatgaatctgtgttaccagctgtgtgagattaattagttacttcaatgccactgtgaatttgggtcctgtgacttaggaaaaaaagaaatctttgctcagttgtggactaaacactgtgaatgacagactattgtttttaatgtcattgaatccaaggaataatttaacatggactctaaaggttagctaccattccacaatatcatattgatttcaaaatatcatattgtaaacactaaaagcatacaatgttatctgtcaatcttaaaaaataaattttgaaaaaagagacactgagtagcataaggaaaatgtatctgcctgtaaataccagcaaaagcacacacattttcttcaaatggagattagacaatgagtttgagattcccaaaaggcagagctgatacctaaactcataaagagagataagtaatcagatgaaaggaagtgataacaagtacactagactctcatttggatattaaatgtcccaaaggagtctttgcccaatgtttgataatttaaattcatgattaaactttctgtcgtgttcctgaaaggctgatgttctttgttgaaggggattcatacactttggatagtaacactgctgggggtaatgtgattgagaagtaaggagggggcgctggagccggaattgggttcacatcccactgaccagccatgtggtgggagcatgttaagtgctctacatcccagtctcttcacctgttaacgggctgatcgcagagcccacctcattaggtcattgtgaatgagctaatgactaaaagaacctagatagtgcctgtcgcccagtattttctaaagtatagagatgaggacagtggtgatgacaccgctgatgaggatggtgggaggaaggccatgatgaagaagaagattgtgatgagaaagatattattatgacagtgatgtttccaaaatgtcagaggccaaattgacattcttatcgaaagggccacctcccctccaggttaaaaggctactcttttcctttaaagtgacatatgaatctgctcaagcacttcaaaatacatggttaggaccctagagttctaggggagaagcaattctgcaggagaggtggcagaatctgtaaaatgcatcactatgagatcaggcctcgggacaaaagcgagagagaccaagagaaacctgctggggagaggagagctcctaatgaggactggctcagatgcagtggcctctaggatatggaagaggtaggaaaacaggatgccctagaaacagagaggaaagatggggcttatgatcttgaagttgaaacaaattttagagatgaaaatcaaggtttagtcattccaaaatagaaatggtgatcatttggagttgaggatgtccagaaagctctctaaggagatgttgtcctaagtaaattttttcatatcttaggacatttcgaagttgataagaatacatggtttttgggaatatatgaggtttttaaattctatcttacatgactttccctctccggagagatgtatccttttatctgtttttgaaatctatataaaagaggagttatgattgatcacaaataatagagactagaaataacactgttgaacaaaatagaggtagtttctctcacttaaaagtttggaagtgaaggctgggagtggtggctcgtgtctgtaatcccaacactttgggtggcggaagtgggaggattgcttgagcccaggagttcaagaccagtctgggaaacatggtgaaactctgtcgctacaaaaaaaaatacaaaaattatccaggcatgtagtcccagctacctgggaggctgcggtaggaggatcatttgagcctggaaggtcaagacagcagtgagtcatgatcacaccactgcactccagcctgggtgacagaatgagacccagtttcaaaaaaaaaaaaaaagtttgcaggtagacagacccaggccagtttggtaatgacatgatatcaatttcccaggttccccttagctttctgctccgccgccctcacggctgccttgtggtacaatagggtcactgcagcaccaggtataacagccagtaacaggaagtaagaagcagggaatgagaagaacaaaggagaaccggccacctgagtaaatgtcacttgaaaacttccccagaagactaagtgacttctgcttgcatctctgtagcctcccttacctgtaagggaggctgagaaataactacagttgtcttcagttggtatgttgcatttatagtgtttgtttaaggaaggagatactttaaaggttacttttaaaagtaaattcttattgcaaagtaagctcatccaggcacggtggctcacacctgtaatcccagcactccgggaggccgaggtgggtggatcccctgaggtcaggagttcgagaccaacctgaccaatatggtgaaaccctgtctctactaaaaatacagaaagattagctgggcatggtggcacatgcctgtaatcctagctacttgggaggcttaggcaggagaattgcttgaaccagggagtcagaggttgcagtgagctgagatcacaccagtgcactccagcctggtgacagagcaagactcggtctcaaaaaaaaaagaaaaacatgtaagctcaattctttagtcctctcgtgttcatttacaatgactatacacttgctgagaagcaacagccacatctctcctatcctctgttgtatcccggcaggcactcaataacagagcatttgctgaacgcttcctgaagataattttaacttcagaacagcttcactgcatacgatgaacgaagattgtacttaaaattgccgctgatacatgaaatcaattttcagtcattgatgttcatgcaaatttaggttggaaacgctagtttttctctgtggagagttttctataagttttcctaatagcttgtacgtatgacttcaactaactgttagttttgaacttcttacataaggtattttgaaatgatctgagaaaatctagttaaactcttcaaatacagactttgaaatatacatgaaaacttcagcagccccatttgtggctttttcattcttgtctcttaggttattttattaaaaaaaagatttctgatttgtagctagaacatggttgatgcccaacaaatactgattgaataagtcatattttcacataaatctcaggtcatggggattaataaactcgctattaattaaagaatgtgtttgcaagtgattataaaatttaaaaaaaacagaaaatttcaaatttcattttccagttctaccttaaaatggcaattggtcatttagatttaataatttaggactttttggcaattcaatgagttctttctaaggtaaatgttttggtgtttaagctataacattatcatacctataataaaaacgacataaaacttataagatcctgtcctccagctggaaaatgagagatgggcaaatgctccagttttcacaaagggacaaaggtaaatggtaggagttaggagctgtcaagctgcaagtgagccataggcagaaattcacatcaggttatcaaatgaatgctggagtccaggctccaatttctaaaagtcagtgtggagtcctgaagaatacatggtgcctcaagtatcttcttttcctgtggggtattagcattttttgttttttgagacaggttctcattctgtcacccaggctggagtgcagtagcacaatcatagtttcggctcactgcaacctcaagctcctgggctcagtcagtcctcctgcctcagcctcctgagtagctgggacttcaggcatacaccaccatgtctggctaatttttgtatttttttttttttttttttggtatttttgtagaggcgaggttctgccatgttcctcgggctggtcttgaactattgggcccaagcaatccacccacctaagcttcccaaagtgctgggattaaaggcatgagccactgtgcccagccagtattcgcatttttaattaaaatattgtgttaattaactgcctaatacaacctctaatagtttttctcttccatgtctggctgcaaactctatggtcacttcttcatataacaattacataagatcattgtctatagaaatataagaacaaaaggtataggctttcttctagcagggttgatagaaattttctctgtgtcatcaagagtttagaaactttttttttgtttttgctttcacaacacattttattattggaaaacttgtgcacattttgaggaatatcatcaaatttaaggacgtttctgtcatatatatgagctatgccaagcttgttcaacttgcggcctgtgagctggcagcatgcagctgaggatggctttgaatgcggcccaacacaaattcgtaaactttcttaagacattatgagattttttttttagctcatcagctatcatattagtgtattttatatgtggcccaagacaattcttcttccagtatggcccagggaagccaaaagattgggcaacccagaactatgcaatttccagtcttcttgtgtaaaaactaatctttaaatcaatgacacatattagctaagttgtcatccacatcctcgtatgaggcatattatgagttttatgttatctttattggagtgagcatggaagatcaaatcggcaagaatttaaatctttttccaatgtgtttattatgattcattcttcttcattagtggctttattaaacaatcaagaagctattttatttcttgtgttagaaatttaccttttcctcttaataaattatttgaggcagaatgatgtcaggatacctgtttatttcattttttaactttatcacttttgattataggccattcaagttttttactaacagctttattgagatataactcacatgccataaaattcacacttttaaaatgtacaattcattggttttcattatattcacagagttgtcgaattatcattactgtctaattttagaacattttcatcgtcccaaaaagaaacccgaacccatgagcagttactccccattgcccattcccccacgctggccaccactgatctactgtcagcctctatggattagtttattctggacatttcatatgaatggaatcatacaatacgtggtcctttgtgactggcttctttcacttagcattatgtcttcatggtctgcccatgttttagtgtgtcttagtacttcatttctttgtgtggctgaataatactccattccatggttataccacattttatgcattcatccactgagggacatttaggcagtttcagtttttggctattgtgagtaacgctgctgtgaacattcatgtaaaagtcattaagtctttatctgcgttttctctcacatcctaaacagctagaataaaaaaaaaaagtacccataatatcactccaaattagtaatctgtaattcctcagttgttttattgaaacatttcaaaatgcgtttctaaattgcagttaatatgacttattcaagacttatcaacttctttttgtcatgtaacttccatatgaaaaaagtacacaaatcctgagtgatttaattctcaacagatcaaacacaaaacccaaatcaagacacagaatatgatcagcaactcaaaagcttcctagggttcctgctagtcccaccacctgctcggtaaaacagctcctctcctgacgtctttcactataaactaatttttttcctatttttaccttatttatataaataatcatagtgtggacccttgggactaacttttgtgagacttatctatgttgttgcacatagccgtaatctattcatgttcgttaccatgcaaatatatttcagtttactccttcatcctactacatgtgggcatttgggttatttccagtttggggataatttaggtaatagtggaataagtattcttgaatgtgtcttttggtgcatatttgaagcttatatgtgtttctgtttggggtatatctacaggtgaaattgctaattcaacttcggttgattccaccagagtagttaactccagtttacagtggaacactcactgagaatcttgactgctatatattttccccaacatttggttttatcagttttttggtttgttattatttttagcctttccaatgtgtatgtagtgacatttccctgaggctttaatttgtatttctctggtggctgatgaagttgaccatcttccatccactggctgttgggattctacttttgggtaataccttttcaagtctttcaaccattttttaagttgggttattagtctttctcttatcgacgtgtttatctttattctggatgtgagtcctttgagttatatacatgttgcaattttttttttacactctggctttcctcttctctctctgaatgaaggtagagtcccaattttaatgaattccaatgttggttgatggttaatgtcatctgtgctctatttttgcctaccccaaaggtttaatttcattgatggatatgaaactatgtatatttcaatttgccaatttgtgtttttccaggaatttgtccatttcattttttttctctatttttcttggttggtcctgccatggagtcattctatccactttattaatcttttcaaagaaactactttttgttttgtggatttttctctattgggtgtttctttgtttttttccttctatctctttgggtatctttcaccatttatttttcaaacccctccctagaaatgatactttaatcattgattttcaatctttctttttttctaatgtatggatttaagactatataaattttcccttaagcatgactatagttgcattacataatatgtgctatgatgtattttcattatcattcagatcaaaaatatttttgaattttcttgggtcccttttgtgacttgtggttttctagaagtatattgctaaatgtgacatatttgggagtgttttttattcttttccattaatttctatcttaattctacagtggttagaaagcatccactatatgattacagtcctttgacatttgctgagacttgctttacaagctcacatgtaatcaattttgatagatggcccatgaatgctttaaaataatgttaattctgtagttgtttagtatcgtgatctatatacatcagttaggccaaggtttacaattttgttgttcaaaccttctatatatgttttattaatctgcttattgtatcagttactgaaagagtgatatgatatctataattacagatctatctatttctcctgttggtactattaaatttttaaaaacttaatttgaggctgtcttattagatgtatacaaatttaaaattgttatatcttcctaatgcattgactctttaccatcatgaaatgtacctctctatctctgcaaatgctttctgctttaacatttatctcatctcgtattagaataattatcttacctttcttttggtcagtgtcatcatggtatatttctttctgtcatttttttctttctgactttctgtaatcttatatttagtctgtgtctcttttaagtggtgtatgtatgggctttgattttttaaaatcaattccaataatgttattgttactggaattattttgcccatttacatttaatgcaagtacaacatattcgggtttcaatctaccagtctaagtatttgttttctatttgttgctcctttttgataaatttcttttcctcttatctcttatctttttcacatttacttgggtttttttataatttcatattcagctctaataacttattagttatacttcattttcatattcttgtagtgggttctgagaaattgcaatatatattctcaacttttggactctaacatcaagtagaatttttaggacttactggataatccaaggactttagaaaatttgagctccttttatcatcctcctaccttctgagatattgttgttatgttttaattctgtatcagtttatgtttttctacttatttaccctttgtattattatttatttatccctgtttttgtgcttccacatggaagaattttcccctctgattaaaaaattccttttattttaaaaatactgcaagtctgctggtaataagttctctcatatattatctaaaaaatgtcttttttgccagaatttttgaagaatattttcactggaggtaaaatcttggttgccagttattttcttagagaacttcaaagataacatttcattgtcttctgacatctatcatgtttgtcaaaaggtcagctgtcagtgttacttttatttccattgaaagaaacgtgtctcttttctctggctgctttcaaaaacattctttgtctttacttttcagcagcttaactgtgacatgctgaactgtggtttaattcgtattaattatacttgttccttaaatatctcaattcataaacccatctcttcaaatatttcttctgactcattttatcttcactgggaccctaattttatatatgaatgtgtttgtgtttgtatgcacacatacatatacaaacatacatatacacacacacataaatatatatatagactttctatgcttctgttgagctatttttaagctcaccaatcctctcttctgtctaatctactatacccatttattgatttaattacactcaggccaggcacggtggctcacgcctgtaataccagcactttgggagaccggtgggcagatcacttgaggtcaggagttcaacaccagcctggccaacatggtgaaaccctgtctctactaaataaatacaaaaattagtcaggcgtggtggcgcccacctgtagtctcagctgccttggaggctgaggcacgagaatcacttgaaccccagagttggaggttgcattgagctgagatcatgccaccgcactccagcctccatgacagaatgagagtctgcctcaaaaaaaattttttttaattaataaataataattacactcatattttaaattatgtaatttcaaattcttttttgaataaaattatcagctgaaattctacattttacctattttcatgaatattttagtcaaattatttacaattcaatgtctgctaactccagcatccattaatagatacttctgagtctatttctattatcagtccttttctcctggtttttggtcattggttatagtcgcctggcatacctaggaattttttaatttaattttggacaacatatatgaaaatgtttagagattagtagaggctctggctgatgattcccccagagaggattcccttttgctttctgtaaacagataagagtaggacaggatgactttaagtcagtctgagatggagttggtttgtggtgggactcaggctttttcaagggtgggtctacttcccagtgttcccttctcctcggatgcagctttcctggggtcctaactgaaagtctggtatgtttccagggctcctccactttggccgaccttgcatttcacttctcagtcccttgtctctgctgaaagctctccttggccctctggcctcttagacagcaccttctgctcagatgcttagcctgctcttcctctgccctcacaatctgggaaatgccttcaagggtaaaagttctatggaatattggcctcgcttcagtgaattttccttctctccaggatcctggactctcaagtattggctgccttaccagctcttcggcactttcaaataagtggggggttttatattaaatccatatcctggttgttctagatttgagggttggtcaggaagaagctttccccaatcatcataaagagagaaaaaatctggattagctttttaatctggagtatcaggaaaatatcagtagacatggtgcggatataattcctgtggcagaaagcataatattttcatttaaaatgtggagaaatataattaaatggcttcacagtacccactccatctcataccatttgcttcaaaatcaacttatttcagtaaaagtttaaaatgtttgaagtgtctcctacttgatgatatcgataagcaagaagggaactctaaatccaagaaagctaaacttttctttctgattcttcacttgatttgacatgaatatctacagttcccttaactctttgggatcttttcctctgtttttgatagtttggtgactccagctatgaagttagaagacacacctttgtgcttccaccctttgccagaagtctaattgaagtaaatatatttatccagtcctccaggattccgtgcaatatatttgagtgcttcaaagaaaagcctcctacttggataagcgtttacttcctttaggagaagagctctttaacatcagatgcacttgtgtctaaaccccgaccacgtaattacacattctgcttgctccaaagagattaatccagaaagccaaccacatatttcttagaagatggaacacatttcaattatctgactcaagtgacttttctggagggtggagtccaagacattttaagtaccagataaatctttgaagccgattaaatgtttttccaaatagtctagactccctcttcctatgaggctttttatagctattatagtgatatatgtgaggcttttttttcctgatactgtaaaatcacatatctgacagttttcagtgtggctgaggttttaaatcaacccaactatatgctactgggatctctatctcatattttgtacagaatggtggggaatatcaatatttaaagaaatggtatttttggagagaagagaacagtgtgatttcagtgcatgggtactagcagtttccaactctgtaaacagtgccatcactcatgattacatcatttcctgttctttcttgtcctggccaacactttgtccaaggactctaagagatcatctactgcaaattgcattcccaacttcccatcacataatcgaagagaggtttgctgcaaaaccgccaacaccttcatttcacatttatcttcacttgaaaggggtgagttcatcacttttttctcctgcaccaagaccataggaagacacgaaatcatcaactaaatcttccagcgttcaaatatcggaggccctggaaacagcaggtatgccgctgaatgtttttgaataaaagagagtgaagggaaacgtttgtacaaatataagcaacgatctacaaatagaagccatcatccaagcagtacagttccaactaaggaaaagggtggtatgtgcattcctggatttaattgttcatacacacaaggatgagctgtcttgcgttgttggaaatgcccacgctgattataaactctgtgtggaatgtcaaaacatctggatttttaagtgaaaaaatatataatctaccatgtggctgtttcttcaagtcactcctaaaggtagacaaggcagccagatgatttattgcattaatcactctttcataattatattcgtgatgtgttgatccccatcatccctgtgtgaacctctatgcgaattccgtgcctttgctaaacctctggttatgctcaagggtcagtggcaactcagtgacaataaaagcaatttttcactatagctggcagagtcttaccaccgagccactccatagcacagtggcctctgaagacttcatccacctccttctattcaaagataatatcctcatactaagagcaacaaccacaaagccataaaacatctacttttttaactctaagaatatgacatgactacacctccataatgcagtgtgcagaatgagaacacaggagttcagaaatagaaagccaagagcagcataaatggagcctgttggaagatgaaacgtccaggtccacactgcacctggaagccattttgtactgaacaattttagaagtaagatcatgggtctgatgcatacatggtttcaaacactgtccacctggctacagcctgccttcgtcttaggccacacgggagctctgtttacccctacgtgccaagctttggcatgtctttgtgccactacacactctgttcccttcttcccggaatgccttttccttcctttgtgcctgaaaaattccaatttatccttcaccacccaacttataaatcccccaggcactttgttacttcctcttccttgtcccaaaacatgttagcccccttcctagcctagagttaccacattgcctttcgcttgtggactcacaacccctctccctaatccgcttggaatgctttgctctttaagcccatctccttttcatctccgcctctagggccaagcacaggggcaacatcaagtgtttaattagagatgagtttattattcatgcagcaaatacttattacagaactgtgttttggcttctgatgtactattaactatcctttcattcactattatatacaatgttacctgtataccattatatgctgcgtataagtaatactctattatgtatgctattctattctaatatgcacataccctaatatgcacatattctagtctaatatataaatctattgtaatatgcacatatcctaataagcacattttctattctaatatataatatctattgtaataagcacatatcctaatatgcacatattctaatatataatatctattcttttctcatatgaacatatctcaatatgcacatattcaattctaatatatatctattctaatatgtacatatcttaatatgcacatattctaatatatatttctaatatgcacatatcctaatttgcacataatatctattgtaatatgcacaaatcttaatatcacatattctattctaatatataatatctattctaatatgcacatatcctaatatgcatatatctattctattctaatatgcacatatcttaatatgcatgtattctgttctaatatataatatttattctattctaatatgcacatgtcctaatacgtacatattctgttctaataatatatgacataaaatattaaatatgcaatattcaacttctggtgtgctatataattatttaattgcttattgccactctcactaaattagaatgtaagctcctcaaggaaagaaactatctgttttgtcatctgctgtggtcccgcacccagcctgccgtgtagtgcatgatcaaataactgatgaatgaatgaataaatggtcgatgcttgacaacaaagacaatcagaatctctgagtcatgttgttgcaaagcacttgcggccaggcatggtggctcatgcctgtaataccagcattttgggaggccgaggtgggctgatcgcctaagctcaggagttcaagaccagcctgggcaacatagtgaaaccttgtctctactaaaatacaaaaaattagccaggcatggtggcatgtgcctgtagtcccagctacttagggggctgaggcaggagaattgcttgaacccaggggttggaggttgcagtgagccaagattgtgccactgagctttagcctggagaacagagagagactccaaaaaaaaaaaaaaagaaaaagaaaagcactaggaaggcatctcattcaatacatagttttatagatgaggggtcctgctcaaggtagaaaacagatcccagaccaacctcactgtggcacaaaatgctgctgccgatgagaaacccaggctccagccctgcactaacatagcaagtcacaggatcatccccaagatttatcattgcactgtagtctgccaagagccgagacagttggagttaaattccatctcagaagtgaataaatgaatctacataaactgcagagatccctgaatctacttccctatcggtcaagtaaaaagaaaaaaaatcaagaaaactcaatgttaataaataatacataaaggaatcgttagagtggagacaggttcaacttatcctgtgagttaaaaaaaaaaatgaaagcaagaaaatattccacagttccagtgtgctgagctcattcttgtgagattaaacaaaataattcaggattaatatattcatttctttgcaaactactatctatttcagttacagactgagtatcagtttttccagtgttggcactttatttttgctgttgaccggctcagatctgaaagacaggattttatgagaagcgtcaccttcagcctgctttgcctgtgtgtgcctgcgtttgtgtatcacacgtgataacgttatgctgtcgctttccaaagtacattcattcattcattcatccacctgcttgcccatcagacatgtatgtgcgctatgcctcctcttttccaggctctgtgataagctagagcgcagggcagtgagtgaagtgaacagggtccctgacctcacgaagcatggctggggacaaccagccaaccagcacatcgatcctgaatgacccctcatgatgagatggaagagggtaaagtcataacagagggggactgcgagggcacttggcatggagctcagggagggcttctcagaggaggtgactgtattcatttcctgggctgccataacaaggtattaccagccatgtggcttcaacaacagatgtttattacctcacagctctggaggcagaagtccaagagcaaggcactggcagggttggttcctttggaggctgggagagagaattggtttgatgcctgtccccacacttctggtggccgccggcaacctttgtgctcctgggcttgtgcatgagcacgagcatccccccagttcctgcctccatctacacctggcttctccccgtgcccatgcctgtgtccacatttcctctttgcagaaggacaccagtcatatttgactagggcctaccatagtagcctcgctgtaacttgattctctctgtcaaggtcctctttccaaataaggttacagtctgaggtcctgagggttcagatttcagtgtatccttagggggagacacaattcaaagtctagcagtgacacagaagtggaggatgcagatggaagcgtccgtgggaagaccccggcctgggaagggcatgtctggcaggaggaactgaaagccacccagggtgaccagagcaacatgaaagagtcagggagggtgtgaggctggagagggcgggaggggccagatctcacccacaagacgaggaggctggatttattccaagtgcatggggaagacattggcagatgttaaaagagatagggaggggggccgggctcagtggctcacgcctgtaatcccagcactttcagaggccaaggtgggtggatcacgaggtcaagagatggagaccggcctggccaacatggtgaaaccccgtctctactgaaaatacaaaaattagccgggcgtggtggcatgtgcatgtagccccagctacttgggaggctgaggcaggagaattgtttgaacccaggaggcggaggttgcaatgagccgagatcgcaccactgcactacaacctgtcgacagagcgagactccgtctcaaaaaaaaaaaaaaaaaaaaagatatagggaggaacattccaagactcagagcccccatgctgcttaggaatactgttagtccacaagagtgagtcaatggctaggagattgctggggatgccaacagcatgagacccaacacctatgtccttcacccaagtgggaataacgccaaccacaggcagccaacatgagtagacgtttatgtagtaagtttcaagcttaggaagcccttccacacgccacatgctctctctcacctaatacttgcaccgtccagcaaagagggtcttgttgtccctccacgtagatgaggaaactgaggttaagtggcaccgattccttccctgaggtcactgggagctacatggtaagagtctggcctctgcatctgcttttcccttgcaaactcaaagagacgtctctccttcaagttgcaagtgtcctatcaagaacggcaattgtgtcgtgagtttctgtgaaaagcaagactggtcattccatcacttctgtctgtccaacatgccccagacttgctcttttggggccccatgctgttaagtaaacatcccccagccagtgtgaatatctgaaagcacctgctttgtacgcagcagggtcagagacctttatatgcacgccctcgagccctcctcctgccagcactgagacaggtaccatgatcgtaatacccctttcgtgggtatggagatgaaggctccgacagctgaagaacttacccaggctccagaccccaactctcaaccctctgctaagctgcttctgtcccgtgaaaggattagcaatttaccagtccagtgccagtagagcccactattcaggcatttctgccggattcagtggcagccattatatgactctccagtggtctagcccttggggtcagctctgtaggattccttgccagggctattcctcggggaatacctatcctgtttttcttgttacacttgtgcaccaagggtttgctgaagcagcccaggtctattaccaccgttttccactctgcttgaacttgcaaacttcaacttactgctggccctcttgctctcacctcacctgcctttttttttttttttttttttttttttttgagatggagtttcactctgtcacccaggctggagtgcagtggcatgatctcggctcaccgcaaactcctcctcttaggttcaagcgattctcctgcctcagcctcctgagtagctggaattacaggcatgtgccaccatacccggctaatttttgtatttttagtagagacgaggtttcaccatgttggccaggctggtctggagctcttaacctgaagtgatccacccgcctcggcctcccaaagtgccggtattacaggtgtgagccaccgcacgcagccacctcacctgcctttctgttcaaatcaggacaatgttttgtgcaaggcctggatataactacagcacacaaaagatttctctcctgggttcattaggataagttcaagttaccctctgtccctccgtcatttcttctcattataaaagggttggagggcttctttcaatagccagtgaagttgattagcaaccttgtatctttattttgataggtccaatgggaaaatatactaatcatttcttatgagcaaagaatagataaaaaaattcatccatataaataacttttcgaaagctaattattatcaagtgcttatctgtgtgaggcactgttcgagatgctttgggaactgtagctcatttaattctcacaacagccctatgacgtaggtactcttattgtgcccatttcacagatgaggaaactgaggcacagagaggtttaggacgatacctgagacttcagcgtggtggggcaggaatgtgaggtgtgagtcagagcacctggttccagaggcagctttcaaacacagcactgcactcccctgagcttctacacactcttccggccccatgggattccgaaatgagagaaatcaggcccccaaaagaccagccttcatcaggagactcggacgagaaagtcaaaaaacctatgttgaacacagcaccattcttgcagcagtattaacttttccacacttcagtatattcatgtgcgtatctactttaaaatcttcctgcatcaccatcaatagcttataattgatactccaataattagatatcataattgaaatccaggttttactcactggagaatttgggcaaagtcctgcaaagcaagagaaactttagttcattaatgaggctcatttttacattagcccgctctcgctacataacaatttttaaatctttttacatttatgatagtcgttactgcagtttcagaatcattagtgagataatgtgcttcttcaagttcaccagtctctgtgaatttgatatacttgttctgagttagcagggttgcagcggcctcagctttttggttcatgcagtcaccgcatgcctaccaaacacaggctgcgggctgaaggctggagattgaaataaggcagcaaattcttgctttcatgaggcttagcagggaggacaggtataaaaatagtacaagggtgaatcttacaaataaattcagagtgctttgggaacatgacctaagggaaatggacccgaagtctgggaaggtcagctcatgaagtgacatcttgtcctttaagacttggctctgctaggtagagtaagaaggggtggtacaaggttagcacaatccaggaagagcaaacattgtgtgcagatgccctgaggcatacaagagcccggttgaggggctgagaggtggggccagggctgggtgggagaggtggcacacacccagggactcagtcccctattacagactccaggaagccatgcatttccctcgagttcccccaaatcactccccagtcacgattaacgggctctcttttctttcacttgggccctttcagcgccttgtttctccctggatctcagcatccttcccagcatgcactatcggctttattgcaatcggtttctgcgtcttctgggcagcccctcttctggggctccttgagggcagacagagcttcactcatcatggtcgtccccttcggcctcggagcggtgtgcacagagggagcacaaagaatgtccgttgcattaaatcaaatctaacaaacagcactttttcccggcagctctacaaataggaacaggtgtctttgctaatcgcccctgaatgcacggttcaattcagggctgtaaatccatatatcagagccagaaccagttagctgtctggtctataataaccacgcactggcctctcacatcatgggcactggaccctgtggctgaaaagaaagtctcaacaaacccaaacaaactgaattgtccacttgtaccagcctcacacaggaatggtcaaaatacctcttttccttcagctctgggaaattgaaaagacaaatcagttagcggaagcctaagactagaggctcacccttcgacaaggaaattcacttgtattttctccggagtcaaggatcccctgtttgcactcatttcgttgttaggaacagaaatccactttcaaccagcagaaacgaatttcctggaaggcattggtactcatcactgggggaggttccggggctttccagcttcaggtgcagctgcgtctaagccctcagacaatgtggacgggatgctccttgtctgcagctccagctgtcagctctgcctgtctctctatgttggctttattctctgctaggctctctccttgtggcaagaaaggtgacttctgacagccctgatgccttatacacaaaggcaggaacacccacatcctctctcccagatccaaatgctactctcatagaaagacttttggtctctctgggtcacagtaccccctcagaccgggcattgattcccaggaaatgatgagataacgcccccacccctgccccaggtcagcagtccccagcctttttggcaccagggaccggtttcgtagaacacaattttttcacagatggcaggggtggtgggggatggtttcgggatgacactgttccaccttagatcatcaggcatcagttagattctcttaagaaacgtgcagcctggatccctctcattcccagttcacaataaggtttccgttcctatgagaatctaatgccaccactgatctgacaggaggcggtgctcaggcggtcatgctcactcacaggatgctcacctcctgctgtgctgcctggttcctaataggccatggatcagtacaggtccgcagccccaggggttggggacccttgccctagatcacctgcccacctctgggaaacaagatggggagaaaatgaggcctgtggttgactgcaccaacgtgacctcaaggagcaggttgtggtggttccctgaagaaagcaatgcccccagatcaaagctacatttcccatctactccagatcctattcaaacagaaccagttcccttgagcctggccatgatttgcatgtgaaaagctggtgtgttgcagccagtctgcaccagctttgggagagctgattgccgcatgtcttgccggttctgcatgtgtgcggtgatatcgagtacatagcttgaaattggccatggggggaatatttaagcacaaaaatggacacaagctacaaatcagggcttttccccctgaattgccattaaacatttaccagcacaatactgtgggttagttatggtgtttgcccacctaaagaaactctgtgtgtgtgtgtgctcatgtgtgtgtgtgtgctcatgtgtgtgtgtgcatgtgtgtgtgcacacgtgtgtctatgtgtgtgtgtgtgtaatttaagccaaaatgacggaccctgtgttatctttgcagatccgtggtctcaggccatgcttaattcttccacgctggtttattggttcctgtgttccaaagctccgcatgtaccctgtttaaaggacggtccacttccaccctatacagttggagggtcacccattcatttgatttcttcaggtccattttcttcatcctccttccacatgctactgaccatcgctaacaggactgcgtgctgagagccgagcctgttacctgctttccccatgacagggctgtctgcttcctctccctgtcccaagatttgttctttacctctcagaactgcagaaaacaagttattttctcttggcatttgtgccgctctttttcctccctcttttggcttcgaaaaagtggtgggtctcatgcacttgtaattagctggagcacatctgacccatcgtcccctgagggagggcagcttggtggtccctagctcaagaaggggcagcccccaccccctgaaattagggaggggaggtctacagctttttccaggaggtacctcagcccaaagtctgtgaatccacaaaagcaaggtcggcctacccttttacgtaagccacgcggtagccagagacaaatgcaagcaatagtgtgatgtgagatagggcagaaacactgcaccccaaagtcaggtgtattggggtctttccctgggagtccgatgcagcaagcaacactgtcacaggtaaaacgtgaggaaacaagcttgcttcttttttttttttttttcaaagcagggtctcactctgttgcccaggctggagtgcagtggaacaatcacagttcactgcagcctccacctccaaggctccaatggtcctcctatgtcagcctcctgcgtagctggggctacacaagtttgcttcttattcctgagctttttaaatttcttcagctgattttgccgtaccgcgtgtgccggtttcatcttcctcctcgttgtaattgtttcatgaccggagtcaatgctagaggccccgaggaatgcaggaaagcaccagccatcaggacgtgttgatgagacacacactgtctgggaccttctgtgaataacatgattggcgttgtcaccgggataactgcaggagagatgtgaaagtgcttaggatgtagttggcgctcaggtcattctgcaggcgttaatgaagcacgtgctatgagccagggtctttgctggggacctaaagatgagtaggtcagtggacaatatttgaatgcaagtcacaaatgtgtggtttccaaacctggactgggtggggctgacagggatttcttccattttttctgtttatctctgaatggttcctttagctgctgacttggcaactgaactcaacgttgtcctctgcccccaaggctctcttttgtccattctctctttctcggaggatgactttgcctcctacttccaattcaaaataaatcctgctggaagaagcaacggagccatgaccaaaagcagactttgggtcgagactgccgagtctctacttttactgaatttagtcctgaatcccacacagactccctgtacccgctctccctaggacgcctcggaatggtcctccgtgatgccgctgcgcctgtgctgtctggaccaccttctgccttggtgttctgacaacatcctagagcatctcacctctctcggctctttcccagttctcatgctccctgatggtccttaaaaagattcctattcagccaggcgttgtggctcatgcctgtaatcatagcattttgggaggccaaggccgatggattacctaagctcaggagttcaagaccagcctcggcaatatgaggaaaccccatctccactaaaatacaaaaaaaaaaaaatgagctgagtgtggcagcctgcacctgtagtctcagctactggaggggctgaggcaggagaattgcttgaacccaggaggcagaggttgcagtgagccgagattgtgcgcctgcactccagcctgggcaacagagtgagactccgtctccggggaagaaaaaaaaagattcctattcatggacctaataccccacttctaggagtggagtgggataaactagacagagatgaacatacatacagcgaagcagaattcctgagaggcctctgatctgaatagtgccaactccaggcattagctacaaaagaccttaattgcaaaactttctggggacttttatctttcctcatctggagtatccacaccattgtcctgcctgcgaggaatttggatagtttattttgtttttcattttgttttgttttttagacagggtctcactctgtcacccaggctggagtgcagtggtgcaatctcaactcactgcagtctcggcctctcaggctcaaccaatcctctcacctcagccccccaagtagctggggttataggtacacgccactgttaccggaaagaggtcccaatccagaccccaagagagggttcttggatcttacacaagaaagaattcgaggcaagtccgtaaagtgaaagcaagttttttgggaaaatcaatgaatacaagtatggctacaccatagacagagcagccccaagggccaaaggactatttcttgactgtgtgttaaacaaggagcagattattcaagacttttccaggaaatggatgggcaattcccagggctttttagaccgtatagggtaacttcctgacgttaccatggcatttgtaaactgtcatagcgctggtgggagtgtagcagtgaggacgactggaggtcactctcatcgccatcttggttttggtgtttttccggcttctttactgcaacctattttatcagcaaggtcttcatgacctgtatcctgtgccaacctcccatcttatcctgtttatgcctaaccgcctgggaacgcagcccagtaagtctcagccttatttcagtcagcccctgttcaagatggtgttgatctggttcaaacgcctctgacactaccatgccaggctaattttgcatattttttggagaagcagggtttccccttgttgcccaggctggtctcaaactcctgagctcaagtggtctgcccacctcagcctcctaaaatgctgggattacagatgtgagccccggggctctgcctggatagtttattttttatgtttgtcacatcgctcttctctgtctccactgataagtcacattccagacccttttatccatgtgatttcttgagatatcaagattcctacagacctgggaggaagtgtcgtacatctttgggcaaaagctgacctgagacaataggcaattgcccttgatgctaagactaaccacaagctcttcccagtctgtagtttttatttgcacatttgcaggctggagtgtgtcctctctatctagtcggtatttcaataggaggcgaagatctctgtgaggcaatctggggtttttctagctgggcccgtgttattcatggccagccagctctcctggtttgtttatacctttttcccacctgaaaccttgatggttgatttgtgaaataaaaccaaaattgctcaatctgtctaaaagctttctgtgggttttaaacttacctattttttaaaagaaattttaataatgcttctggcttttagaatcagcaggaaacctacaatcaggattgttgtatttgcaccaatatcaaacataaggagcataagtaataaggaacccagtgccctttgttgaatacgtaaattttcatggtaactggtaattgctggcctataaaagctctcttccttatgttcctgctactgagtaaaaatgatttttgtatttgtaacagactagattcatttcaaatggaaatattaatctgtaattgttcttatacgagaaacaccaagttcaaggcaaaaataacaaagccagttaagcatatgtttcatacctgcacaatttacctaaatagagattgcccaaagaagttttgctggcttctgaaaactttctcataagattttaaaaatatattttatggtcaagaggttgtagcatcctcccaggactaattcatatctagccaagaaaaattacattttcccatttacattccaaagtctgaactgttattttataaatgaattttccctccaattcagaaagcactggctacattacaaattttaatgctactattataggatcataattttaaaaacccagggttctccaagggcttcagcagcatgccatctctccactttattaaaatgaatgaacagatgtacaatttatttctgccaagccatcatctaaattcataagctatttctcatgtgtctgaaatccacgttggtttcccattttctttgccttagaaaaaaaattacactccctcatttatcactctggggacataaacgagaagtctactctccacttcattcactttggactaatatcctcgacacaatttaaatcccatctcttcaagactattcaatgagagcaaggcagtggaacacccagcatccaattggaaaactccttggccatcaatgtagaagattgacaagctcagtcacatgagcttacaccttggcagatgcaggggaagagagcttacaacagcgttgaatccattcaggtagatgggacagtctagaaccatcacacttaaaagtcaacgtcagtaacagaaatgtattttagctgccgtatttcatagagccctgataccacccttacttcccacatgacctgtcatctgacagcaggctggcagacaggcatttaacagattcatctcgggttggcaaacatctagcctagctttgaaaacccacgtgttgatctcagacctgcctttacatccctgcaccaccattttctgatggtgtgagatcaggcatagtttttaacctctctgagatctgggttatttttcagtatgatggagataagtggacctgctttgtaataaaggttaaataaagtgcaacattttgatgctatgaacctaaaagtatctgggacaggtctcagtcaatttagaacgtttattttgccaaggttaaggacatacccataacgcagcctcaggaggtcctgatgacacgtgcccgaggtgctcagggtataacctggttttatgcattttagggacacatgagatatcagtcaatgtgtgtaagatgtatattggttcagtctggagagtgggcgatcagggagcttacaggtcataagtaggtaacagacaaatggttgcattcttttgagtccttgatcaaagacggcggtagaggaatagtcacttatgtcttagtctagctcagtgaatctgcatttttacgtaaacaatcagactgaggaagcaattagatatgcatttgtctcaggtgagcagagggatgactttgagttctgtctgtcctttgacctgcacctgtgaagatgagcgatcagtttacgttgcccaggtgaaattcaacagaagtttttagagtaaagatcttgaggcccacaaggaatttccttgcaggcaaattgtgagggagatattttctatatttgtagctatcttattaaaaataaaatgggagcaggtttgcctcccataggtcccagctagacttttccctttagcttagtaattgggggtcccaagatttattttcctttcacaatgccaaggtcaataatatatggcaagcacagtgcctgacatgtggttcagtaagggggccattgtgatgaagatggcatcccggagatacatctctgccgcagaacagctgggctaaaagagctctcctcttcctcagttctgcatttgctggcatggttctagtgaatgtaagaaaggcattttgcagccagcagatgcagtcaacgagcgcaagttgtaaaggctgcagaatgaagccctcaggttatctggcagaattctgctcctggaagaattctatttatgagatgctgctggaattgagcaataaaacttgccggagtctctagtttcacatggaaaactgccctgtgtccataaatgcttcttgggtttggggctttaatcagattttgagtgtttggtttgttgttgtttgttctttcggtggccctgttgcttggagaagaaacatcatgttaacttcatttgcttgaactctgtgaccatcctgtgatttcaaacacagcttgtctttttctcatgtaatgtttttgggaggggaaggtgggttctcctgatctcgggaagatccacagcaaaatgatggagttctttcatttagcagagttacagcttgaggtggacagtgtcaaaatggcaagctccccaaagaggaaaggaaagagggatgtcactccaggatgcgccaacgagatgctccttaggaaccacggaagtgacacttgtcagcatccacacaacaaaatgttgatgaggggagccagccttggtgactcctagcagctcccggcagcagtctgtctgcctgtgttgtcaacagtccctgaattaaatcagtcactgctgccgccaatgaacttgtaggttgttgtgggataaggggccctaggcagtttcttcatctctgcttgaccaaaccacgcatcaaggtcatggatcccaggtgcccctgaagacattcaagaagtctcgttcgccagctgagcaaagtcatgagacaaactgtccatatgacaagcctgcttttaggctttgacattccagcaaggaagcaggtgctgctgacagaaatgtggtagtttgagagaacaggattttaaagaagaacgaacccaattatttggatccacagagtcttagaagatagaatgcagggaggaggcaagcagggaggaaagagaaggagcttttatgtttcctcattgttactccatcacactgtcagtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcctcacttacagaatagggattttggtaatgaaggccagcagctccgtgcatgacaaggtgctgaatgctttctgtttattatcacgccgaatccttatgatttctttgtgaggtgcattctactagaccctccagttctcagatcaggaagctgagggttagagagctaaggtaatgcacccaggttacagcaggttatcctcaagtgccccacggagtagtgacattttgtcaccattgatgctatattactgataatgatcaatagataggttactggaaaggggtccagatccagatcccaagagagtgttcttggatctcatgcaagaaagaattcagggcgagtccatagagtaaagtgaaagcaagtttattaagaaagtaaaggaataaaagaatggctgctctataggcagagcaacagcatgagctgctagttggccatttttatggttatctcttgattatatgctaaacaaaaggtggattattcttgggttttccgggaaaggggtgggcagttcccagaactgagagtttctcccccttttagaccatataggtaacttcctgatgttaccatggcatttgtaaactgtcatggcactggtgggagtgtcttttgacatgctaatgtattataattagcatataatgagcagtgaaaatgaccagaggtcactcttgttgccgtcttggttttggtaggttttggccagcttctttactgcaacctgttttatcagcaaggtcttcctgatctaaatcttgtgctgacctcctatctcatcctgtgattaagaatgcctcaacctcctgacaatgcaacccagtaggtctcagccttattttacccagctcctattcaagatggagttgctctggttcaaagcctctgacagatactgcatccatgaggtgaataaaggtggcaccggtgttcattttattggctaagaaccccgaaattgtcacattgcgtgcagtggttccggaggtttgacctcaccgtagaagagcacatctgaagttagttttgaacatattgacatcagtgttttgaaactcctcaccgctttctaacagtctttccagttagctgagtcagcacaaaaggccttagccaggtctgaaaggagtttgttttcatgttgcagggagtgttttctaataagggtttttttctccattgaaaacatctcttactttgcgtctatcattatgatcttactcggagagaaaatggtatcttcctgggctgattgctcattggtggaggcttggcttccaggaagacgcacactggctttccgtagcactttctctcgtttttgtttccaaaatcactatttattgcccttcaaaacaggttgcgtttgaattagggttctgggcctgtacagtctgtgggagcccaagtgcaaagtagattccatcataaacaaggtatcccccctccaaattaacagtaaaataggccatgtgatcccagaatgcatcatttcaggcttataaagaaaagcaacttagtttccttatttttccatttttccatgatcacaggctcacagaagttgcaaaaatagtgccagaagcaccttgaacccttctctcagcttcctccgtagtaacatcgcctataactgtagtgcaacaataccaagagcaggaagttcatgtgggcacaatactattaaccagacctcacgaagtctccacccatttttgtgtgttttctgtgtgtgtgtgtgtgtatgtgtgtgtgtgtgtgtgtgtgtgtggtcctacgcatttgatcacacgtacagatttgtgtgaccaccaccaccatcatgatacaggacagctgcatggtcacagaagggctacctgtcttgctactccttattagttgtattaaccttccccttactcttgggcttctcccctggcaattattaacctgttctccacctgtagttttgtcacttcaaggatggtacataatggaatcatacaatatgtaactctttgatattaactctttttttttttttttgagacggagtctttcccagccacccaggctggagtgcagtggcacaatctcggctcattgcgacctccgcctcccaggtttaagccattctcctgcctcagcctcctgaatagctgggactacagatgcctgccaccatgcccagctaatttttgtatttttagtagagacagggtttcaccatgttggccaggttggtcttgaactcctgacctcaggtgatccacctgcctcggcctcccaaagtgctgggattacaggtgtgagctaccacacctggctgagatgagctcttttcactaagcatgatgcccctgagattcatccaagtactcacatcagccgatagctggttccttttgattgctgagtgatattccatggtatggtatgccagagttcgttgaaccattcacccactgaaggacatttgactttgttgctagattgaagctactgcagttagagccaccctgaatatttgtgtaaggcttttgtgtgaacatacatttccatttttctgggtaccagctgctggatcatatattaagtgcatgttagttttataagaaactgcctgttttccagagtggctaaaccattttcatccttatcagcaatagaggagaaatccagttcttccacattctcaccagcatttggtgttatcactctttttcattataaccattctgttcagcatatagtaatagctgctctctggtttggtgtatagcaatatgatgttaatttgcatctccctaataactaatgatatgaaacatctttgcatgtgcttatttgccgtcagtgttctctttggtgaaatgtctaactatgtcttttgcctattttttgtttcgttttgttttacaggccattttcaggactttaacttttgcccattttctttctttttttttttttttttttttttttttttgagacagagtctcactctgttgcccaggctggagtccaggggtgtgacctcggctcaccacaacctccgcttcctggggtcaagtgattctcctgcctcagcctcccgagtagctaggattgcaggcacatgccaccatgcccagctaatttttgtatttttagtagagatgcggtttcaccatgctggccaggctggtctcgaactcctgacctcgtgatctgcctgcctcggcatcccaaagtgctgggattacaggtgtgagccaccacgcccggccccattttctaacagaatcttttaatgtttgagtgttgagagtcttttatgtagtctatatgcacatcctttgtcggagatgtggcttgcaaatatttatctcaatctgtggcttgtctgttcgttatcttaatagaatctttcacagaacaaaagtttttaatttcatgcaagtccaatttatacttttttcttctatagattgtgcttttggtgtcaactctaggaattctttgcctagccctaggtgttaaagattttatcctctgttttcttctacaaatttttatagttgtatttttacatctaagtccatgatcctttcggaactgatttttttatgtaaagtgtaaggtttaggttgagttcatttatctgccagtggacacacagttgctccagtagccttttagaaatagctatccttcttccattgaattgctattgtccccttgattaaaaaaaaaaaaaatcatgtgggtgcaggtgtatttgtgcaggtctattccgtgtcctccgttctgtcccattgatctatgtctctgtctcaccagtactgtactgtcttattaccggagctgtagagtaaggcttcacatcaagtagaatgagtcctctgctttattcttctttttcaaaagtatttcagaaaacattttttttcctttttcgacttttactttagattgcaggaatacatgtgcaggtttgttacgaaggtatattacatgatgctagggtttggagcatgatgaaccctagcacccaaattggtagtttttcaacctttgctccttccctccccacttttggagcccccagtatctattgttgccatgtttatgtccatttgcacccaatgtttaactctcacttcggactgagaacctgcagtgtttagttttctgcttctgttcattaagacaaaagcctccagctccattcatggtgctgcaaaggacatgatttcattattttctatggttacatagtattccacggtgttttctaacccaccattgatgggcacctgggtttgttgcatgtctttgctgttgtgtatagtgctgcaatggatatatgggtgcatgtgtcttttcagtagagtgacctattttcctttgagtatctactcagtgatgggattgctgggccaaatggtgcttcaactcttaggtctttgagaaatgtccagactgctctccgcaatggctgaactaatctacattcccaccagcagcatatatgtgttcccttttctcctagttctaccaacatctgtaattttttgacttttgaacaaaagccattccaactggtgtgagatggtaactcattatggttttgatttgcatttctctgctgattagtgatgatgagcattttttcatttgtgaattggccattcatatgtcttctcttgagacatgtctgttcatgtcctttgccctctttttaatggttatttgtagaaaaccattttaaatacagtttgaactcaacagctttttatcccctctaaaattatttttctgattaaaacataactcatttccattgtaaacaacattaaaatatcaaaaacgtctaatagaaaaatttaacagatctcgggaggagccaagatggccgaataggaacagctccggtctacagctcccagcgtgagcgctcccagcgtgagctacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggatgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgatacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggttggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaagcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgccggagaggatgcggagaaataggaacacttttacactgttggtgggactgtaaactacttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctataacttagagtataataaaaaaaaaaaaaaaaaagaaaaaaaaaatttaacagatctctccacacacctgagagaggactatgttctttcccttcgtatatatcaagttctacttttttatttacaaacgtgtgatcacactctcttcagtatattgccatctgtctcacgatttgtatctttttccttgtctgtaaaaagggagaactattaataatactctatttctttagtctttggtgaggatcaaatgataaaacacatgcagagagtttaacccagcacctgctacatagtaatgtctttgttgatgttatttttattgttcccccttcagcttatgctacctgctttgggtgatcttggcctttcttggtggcaataaagggcagagaaactccataatgtttagtaatccaagtcagtttgcagaagcagtcaggagaatgggttcttccatcactcagtccaggtttcctaccaaatagaatgaatgagacaggtagtactgcaaattcatagtttacttacgttaatcataatgtcaaacatgtcaacagcatcctggagagccccccaagtttcctgtccacttgtccactgtacagccacctacccacgctttacgtactacccagctcttcctctaagtgggatcctcccagaaagccagagctccgctcctagagagcgtttgaggaacctgcatgtggtttgtcttatcttcagatctttaacataagctgtaacgagggcagctagaagcagagcctatcagatcagcccccgccagctccaactagtgaaacccaacagagtccttggaccctgcagcctaagaacataaaaattctgtaatctccttctctttatctcagctctgccttcagatgtgtcccttgaatggcccacattctcccaatttcattaacttagcacattttatttccactaagtaaacccaaggtgcttccatggtccaatataacggatttcccttctgatccataatgccaaacaatatgctacttcattccctttaatggctttgtattgtgttctgttttatagatgtcccaccatttgaccaacttcacataaatggacattttgatggtggttcctggttttcccttttataaacattacagcaataaaaatgcttgaatgtacatcttcacgtacatatatgaaagtctttgtaggataaactcccaaaagcaaaatgcctggcccaaaagtatgagcactttacattgcagtttatagctctttttctaatatgattaaagtatttttaaattaccttcacttttgtcatccctcagttacgctggtttctgtattgcatagattcctagcctgctccactgcaaatgggctgccatacagaggatgaggttcatggtccagaaacgcatctggtactcaagcgcagagcagaggtggaattctaggcctgtgaatggttcacatcagcagtgggggtccccagtgaagtaggatcccaaaggccacagcaattggacggatactaatatccttcatgcttccacgggcatgaacttgaacttgcagtggaagcctctaaggcacagcaaggcaggagcagatatgaagtatgctttgcagctgtagctcctctagaatccaggggctaatgatcaggagggaggtgctaaatattctgggctcctcgcttggacttcaaacctacaagctccccactcttgaacctaaccccattcctgagtttccttctatgctcacatccactcccaaatcctctaaccaccctgagctacattatattaaaagggctactcctcatatgttcaccacagcactattcacaatagcaaggtcatggaaccaacctaagtgtacatcaacgattgactggttaaagaaaaggtggtgtatacacaggtgaaatactatgcagccataaaaaagaatgaaatcctgtcctttgcagcaacatgggtggagctggaggctattatcctatgtgaattaactcagaagcagaaaatcaactactgcatgttctcacttgtaagtgaagggtaagcaatgggtacacatgaacataaacgtggaaacaatagacagtgaggactccaaatgcagggagagagagagatgttggggatgagggctgaaaaaccacctatcaggtacagtgtttgctgtttgggtaataggtgtgctagaagcccaatcttcaccaagagacaatatacccatataacaaacatgcacacatgcccccccccaatctaaaataaaataatttttttaaaggtactccatcagaacacccccaacctcccgcaccctcaggtgtggcattacagaaacctcagcagcaaagccccttccccatccttctccaatcaccagagcactatgctgactcccagaaaggccacatgagaagaacttgctagcccctgcaggtggcccgttcttggtggtagagcataagggaaggggcagggaaaacaggaggagaggaggcatcatttcctgtaaatctagcacaggcttggtttgcttagacagtggaaatactaaaaaagtcaaaaagatccttcatcatacacaagaaaaagggagacgaaaattgaggtgaaaaatcattctgccattacttagaaaaccaattgtgaatcctttcctggttttaaaccatagctacataaactgggggaaatgtctgctgtaggtttgctccacatccagcctcgccccgttgggagaagccttggagctgtatgggttggagcagtgtctgtgtagagtactgatgctctcccactgggccctagtgtgggaccatacgtgaaagccaccaggtagggttgcacatagactctagactcagaccaaccggggtctgaatcccatctctccactccctaactctgctaccctaggcaagtgcttgtacttctctgtgcctcagtttcctcacctgtaatttggagctcatgacggtaacctaccccactgggtgagtagcgtacccgggtcatgacatgaaggatgtatgtaatcgttagctgtgattatcaccattccactaataagctttctgttgctgccgttctgcagggctcaactttctttagaaaatagttgtgttggccggacccagtggttcacacctgtaatcccagcactttgggaggccgaggtgggtggatcacctgaggtcaggagttcaagaccagtctggccaaaatggtgaaaccccatctttactaaaaatgtaaaacattagctgggcgtggtggcgcatccctgtagtcccagctactcagaggctgaggcaggagaattgcttgaacccgggaagcagtgagctgagatcacgcgattgcactccagcctgggtgacaagagcaagactccgtctcaaaaaaaaaaaaaaaaaaaaacacacacacacacacacacacacacagttgtgtttgcatcctgttatttgagttagctcaattctaccaaattcccatcctacagcctgttccagtaaccgcagagccatgagacctggtctgatggcttcttctctagctgcttgtatcaaaagaaggcaactcccccctttccccttcacctgctaatgaggcctggaacttgcagtccacatcacagcatcatttacgttttgtcctttcctggaggtctacaccaggcacctgggactgcaggctttctctctcccctgggtcttaaattacagtaacatcggccaggcgcggtggctcacgcctgtaatcccagcactttgggaggccgaggagggcggatcacgaggtcaggagatcgagaccatcctgtataacacggtgaaatcccgtctctactaaaaacacaaaaaattagccaggcgtggtggcaggcgcctgtagtcccagctactcgggaggctgaggcaggagaatggcatgaacccgggaggcggagcttgcagtgaaccgagatcatgccactactgcactccagcctgggtgacagagtgagactctgtctcaaaaaaaaaaaaaaaaaaaattacactagcatccactcttaccctacctgtaggaagtaccgtgttgctcacgggtgaccccaggaggcttacctttctgttttgtttgtgaaagtttctcccccattttgcttgtgcttccatagcaatgatgctagatgttggctcactttggaaacactcccttcctacaacataaatgtgtgtatgtgtgtgcatgcatgcgtgtgtgtgttgaactgagttacttatgagctgggcttctgcaaaacctgataatcaagggactctgtttccattcagaaatagctgtttttgacagagaaggaaaattgacagatttttccatattcggggattatctagaatatgattcccctcaaatggcccatctttttatcctcaacaatcataggatctgtgacacgtgaagaataagtgttatctggttggtgggtaccagcagtggtgctggtaggaccaaaggggaagagattctgtccaggagtctccttgactggtcagtcctacctgggtccagaaagttgatagccacgatccccattatgatccctgttaaaatccccatgccatggggatgtgttataagcacacatgcaagatgcattacaaacctgatcctaaagccccacaactgcctgataaggtaacagcattatcccagttcttcgcctaaggaaactggagtctagtgaccacacctttttttggttccctgacttagaacctcttaaatattccctcaaggtgtgtttgaatttgttgctttgtaaaggcaacaaagcaggagttaagggaaaccaaagccataccttggaaggaccaaggtatggggttaataaaacacggatgtttcatcatccaggcgtgtaaattacacatgtctggccgtgtgttctcagagtcacatgtgtattttacatgcaagaacaagccagtgggtggtctcgaggcagaacaactcccaggagaactttccatatggactgttttggagacttaagggtcactttgattcaacgcaagtttgtgtgatgcagtgattttagaaactgtagcaagaaggtaaggcttcatggtagttaatgcagaggcatcaccgtgacttgccagaatccttcctgggtggtgtccatggttcctgccacccctcctccctcccagaagtcccaggcttagtctgaatgctcagtctttctgcagctgcccagagtggtcagtgagttacactggaggcttcaaccactgggtttccatagacatggaaatttccattcatggtttctactgacaccgaccccctgggaatgctgaaaacactagaacacagctcttgattcgctcagattttcttatttaagacaaagaaaatttcttgtgcaaaaatcgagtcagtatcattctatctttattctctattctctctctccctctccccatctctgtctcctgtctttattttcttccttatctatccccctttttctctttccctcgctgtttctttcttcttcctttctttgtctcttttcctaacttttttgcatatgtagctgtgtcttttcctgccttctttttctgcactctatccccagctctctagcttccccgcaacacacatacaccacctactatgctatctggcaattcccactggggaactgtggcaagacatcttatcactggggaaggaaattcaagctgaaagaattcacctttttacttaaaatttcttaactctgtgactattcctgttttctacttatgaagtccagcctcctcgccccccattcccctcaggtgtggcagtgaggttaaagtggccacaggctgctgttggagtgagccttcctgctccatgtgggttctataaaatgtgcccttggcacctgttcaatcagacccaatgaggattttggaacagtatgttttctactgtaattacatctcaacagtgaccatttatattattccttgattgcaaataaatttacagtgcttatttttgtgctccctaccttcattgcatttttcaatatatttaatacactttaatcacacagtgggaggtgaggaaatacgggcccctcttgtgaagggaaagagagggtggttgggctcagagctgctttttctttgttacgcatgttgtggttgttttctaattggagagtcatgaacatgtttatggacctgcaaggagaaataagttgatgtgcagggaaggagggcaggaaggggtaaggcactgaggagtacatagccggtgggagccagggactggagttcactttgagcagcaaggaagatagcctcctgcagccaggggaaggaggcaagaaagaggcaaagggagggggcctgtgggtttccaggttggggatgctgaacacggagggcacctgccttctcgcactcttcccctgtgggtcaagcagcaaggtctgctgctgagagaggcaggggtctagagcccactttgcagctttgctgaagcacccagccacctgaggacctgattcaaaaggcgggcccaggttgtacctttctaaccagctcacagctaagctggtccaaagcccacactttgcatagggaggggaaaatggatgacatgccattttttcttcattgtcaagtaagctggagtctgaacacgttctaattggacaaaatggaaaatgcggtgttttaattttctgaggcccattgagacagccccaagggtgacacagctgcctcctttcaagcctctgctcctttgtaggttgatggaacttgaccctggctgtaagaccagaatcaatgtgttgcacctgcatccacttggcacccacaggtataaaatgtatttattgaaaagcagcaggaagtacagaaagcaggaaaaaaaatacctttcttcttttataaaagggattatcagctgctaattcaaaaattgtagggtaatgaaaactacatcaataattttcataataattatagtctttggttttacccttgaatgtttttctggcaacatctgattcaattaccccagaaaatgttactatgctcttccagcattttcctatgatgtttgaatctatgaccaaataagtgataactcttgtcctaggggagcttgtgggctgccgtacacaggcaactgtcatgtagggagacctgacacacacatcttagctggattagtggttctcaaccccagagggttttccacaccccgctgggacacccaacaatgtctgaacacattttttattgtcacagcttggatggtgctaccagcatctagtaggtaagaactaaggatgctgctcagcatctcccaatgcacagggcagcccccacccaatgaacaattatccatcccagaatgtcattagtggcgaggtcgaaagactctaagtgagattaggattacgattagattacaattcgaaaagaaaaagcagggtggattcggtggctaatgcctgttatcttaacattttaggcggctgaggctggaggattgcctaaggccaggagttcaagaccagcctgggcaacatagtgagaccctgtctctataaaaattttaaatatataaaatatattttaaaaatttaaatatatatatagtgtggtgtcacatgcctgcagtcccagctactctgggggctgaggcagaaggctccattgagcccgggaggtcaaggctgcagtgagccatcatcacgcaagtgtattccagcctgggcaacaaagcaagagcctgtctcaaaaaataataaaataaaaatagttgatcagaacacttctggttataagagacccctagctctaagtagtttagataacaaggggactttctattggtaggaatattaggtagtgagagactagggtactgtaacaaaaagttcccaaaagaacaacgtgtatttctttgctcatgaaattccttaaaatgatgttcagtgcaacaaacatcgtttctttatgtattttatttatccattttcattataacaatgtgcattttattgcttatgtgctgggcattcatgtaagcattttataaattatttaatccatcataatcctgtaagggtaggtattattattattaattattcccattttgcagatgagaaaatggagacacggagaggttaaatgacctgccaaaagtcacaaagataacaagatgcagcttcctgtggctttcaacatgaatcactttcctcattggtcttttattttcctctttttttttttttttttttttttttgagatggaatcttgctctgtcacccaggctggagtgcagtagcacaatcttggctcactacaacctctgcctcccaggttcaagaaattctcctgcctcagcctcccaagtagctgggattacaggcgcccactaccatgcctggctaatttttgtatttttagtagagacagggtttcaccatgctggccagctggtctcagactcctgacctcaggtgatctgcctgcttcagcctcccaaagtgctggaattacaggcgtgagccaccacacccatcccataggtcttttttaatgtgacagagtgccactggagtgcgtctctcctcacgcagattttcattatgttactccaccctgtgatgagagcccaggagggacagagaatgctttttaatcctccttatctcattgagcctgattcccaagggaacgattctcatccatttattctccctctgggactcagaaactccatcagccacctctggaaggaatatgcgacgtgctcatgggaattacagtcgggcccaaggggtctatttgaaatgggaatcagtggtgcaaacacagagaatggatttagagcagtttcttctgactaagacatttggaatttaaatgcaaattagaagctgtaagtcaattccgtgtatgaatttatacaaatcccttgtaatgaaagcagaaggtttctcttgtccttgtttgtgctgtggtgttagcatcacgagcctaaccaagtgtgtcaatctccctacagctctggagattagacatgtgctttctccagttagagacggctgtgagtgccatgctgggggtgggattctccatgggctgcaggggtctgtgtagtttctccattaacttcagcaacaccccatggaaattgggaagaaggagggtcctcgtggtttagccaaaggttttgaaagagacaaggctctcattgtaccccctctttactggcccctcatgccattcacaaagcaagccctcattctcaaatattgcctttcctcactcaggagctggaggctgggctctgggaagctgacaggccacggtctcttgtatttgaaaggagcaacccaagggctacatatgggttaacaaatgacttgaatccccagcgcctgcagcctggagtccccatatgacccagcagctccactcctaggtgtaaaccgaagagaatgaaggcataagtcctcccaaaacttgcagatgtgaacattcacagcagcattattccccatagccactaagtggaaacagttccaggtccatcaactgataaatggagaaacaaaacatggtccatccacatgacggaatgctttcagccacacaaaggactgaagtactgatccacgctacagtgtggatgaaccgtgaaaacacgatgttcagtgaaaaaagtcagacagaaatggccatatattgcgcaattccatttctatgaaatgtccagaacagggagatctccggggacagaaagccaattagtggttgccaggggccgggagtgggtgaagaatggggagtggctgctcctgggggtggggcttctgttcgaggtgttaaaaaaattctaaaattgattgtggtggtggttgcacaactctgtgaatgtactggaatccattcatatgtacaatttaaattgatgaattttttggtatgtgaatcatagcgcaataaaactgttagcaaagaaaaaactgcatagcaccatgtctaaagactataggggatgtcacccaaagggtcacctttttaggcagaacttgagctcttgttaaggtttgaaaaatcacaagctgttttttttttttcctccatagctcagaaatcaaaccagattgaggaaaatctttctagggaaaaaaaactcacaaaagctgagaaaattaaaatatatagagctcctagaatcaggaattgtagcttacttttaatatcatcagcactctagcatagttctggtacttaggtgttgaagagttgacaggaaacagaacccaggaggtaaatgaagaatcaatctgttgggaagaggtttagaaaggaagaaatcacttaggaattctcttaccctgctttatttttcttcaaataatccaacaagctgggtatttgattatttatgtatctatgtagcatctcactcccacatagggacaacactcatgacagaaggggcctcctatggtttgtccgctgctgtgtccggcattaagaaaggcgctcagcacggcgtcatcagccataaatatttgtggaatgtacagacaggggattgaaggcttggataggggaatatgtccttggagagtgaaatgaacgagtggctaggaacacacacatgggtgggggaattaacatactgacagggaatgaacaaatgggtggggtaatgaatgcacaaatcagagacttaatacatagtatagacagggatgggcatgtggctaggggatgatggatggaggataaaagtgtggatagaggatgaatgaatcattccagcagagacttgtaggcagccagcatgactgaatttgttccggttctttctatcaggctggtgcaaaagtaattgcagtttttgcaattaaaaatggcaaaaaattgcaattacttttgcaccaacctgatacatctataagcatgtctgggggaagggtccctcctgcaccctcacgtggtggggtttatctgaacattagggtataggccatagttaggaacagcccctgaatttaacagagaaagaccctgaagcaagtaaggcaggtcaggagaccaggatgggcagaggtcctgtataggacaatgtgcaagaaaggacccaacaaggcagctttgcaagatgtcgggatcaggggccaagaggagaagaagcacaagaggtcagacgaagaatcctgcagattgttagccccaggatgaggaaacaggcctgagagtctcatctgtttcatcagagagcaataaaagaaaattaaaatataataatgccaggatgttccaaacagctctttattgctacagaactaccatgcctgtactttcgtctccaggcaaatatactcaaaatagtttcctattgctccactcaccccatcattcgtcccctttctgcattaggcctacgggttaatggatgctgccacctgatccctgcatgatttcccaccaaccctatgactctgggttctggagaggtgaaagagcatctccaggtggctcaaaactgtggctccaggtactactcctccaggcgggctgctccctggggcacgtgttctcagtccaccagtgggccatgccgcatcagcccacctgcttcctggcacatgggatgcacagcccatgaccttggacccagcagtaggcagcatgctttccagttttgaaggcaaggacggaggcatacaaggcactacttgagatcctgtctgatttagaattttgtaggacggattcctgttgttgaacacactgagtgatgagaaacttggcaaatcttgttggcaaatctctcaccttgattccctttggcatcctttgtgtctgtctgatccttccagcctggcctttggatagcaggtacccacttcttaggatgtgccagacaccacggtaagagtttgatctgcacttgttcatttattcaccagaatcacctatggagttagcagtgaccctatccccattttacagataaggaagtaccgaggcttacagaggtgaagttgcttgtgtcagggcacccagctgttgagtgacaaagccagatcctctgaggtggggcactgagcagaggcccgaatggcaagatggtgccagtacatgaagacaagagtctgtcagagagaacgacacaggtagagtcctgcagcttgagcaactgtttacaaacccatggcagagcccatgtgaatgagggagaaaaggcagagatgggcagatcccagaaggcctgggaacccatggaaaaggctctggattttgtaaagtagaagctgttgcagggctgcgaagacagaggaatgtcagctccatgagggcaggaatgtgtgtcttctttgttcagtgaagactcccaaacacccagaatcgagcctggcatgtagcaggtgttcagtggcttcattgaatcaatgaatcatgtttaaatttgtaacaaaatgactctggctgctactatgcagaggacaggttgtagagagaaagtggcaggggggaaaacagaggaggagtcaaacacccctgtaggagataatcaaattacctgagcggagcttctgatggctccaccaaggttggtaggggtgggacacagagaaataggcctattcagcacatattctgcatgcatgcaaccattaccactatctaaggctggaactttttcatcacccgaggggaaactttacacccattaagtggtcattctccattcccacccctcacacccagcccctggcaaccataagtctgttttctgtctgtctgagtttgcctcacagatatttcgtagaaatggaatcatatagtttttaagagttgttgctgatggactggatgtgagaaatgagaaaagagaggaatcaaaagatgactcctgcattttcagccttcacaacatgaataaatggtggtgctctttgccaagaaaagggagaagggggaaagatgagatttgttttggtggagtcgggaggtggaaaggcctctgtttcgatcatgttaagtttgaggtgcctgttagacacccagaagcagatgctggctgtgacttggcacttacaatcctggatacagggcagagtccagggttgggggtgtgagtgtgtgattcctcagtagagaggcagggcatggaagttctcatccaggtgctgactgatgaagagctgccattgcccaagctgggaccagaacccctgagccatgttaagaaaaagtcaaccagatccaggcattgttacccttgaatggtaaaggtgatttagtggaatcttgatcaaggctcctgagccatttcctgtgggaaagtagacatctttgaatgactgcacagagaatcgtggtctttgccactctcccctacagttttggcaatatcacagccaattttagggcacaaacacaaaccattcccagttatcctttgcctgtaataggaataagacagcatggtgtaaggaattacttgattttagaaggcatttcatctctccaagtcaatctttagggatcgacactgctggtggcttatgaatttcagatgtggtacattctgggaatgccagctcttgggctccaggaaaggtgattaaaggacaggctgatgccaacatttatggagaataaaacttgcacttcaggtacagtaaactcagggcactcagttgggcttcactcttccatattcttaggaaagactaaagtcacatgaataagatctcagccctgcatatgtaatggcaaaatgaatgatgtaggctcttcctttgagaaactaacagactgtggatccagctcattgtaaagaaacagccatatgagtgatgtaaagggtattaatccctcaatacaggatcatttatctgtagtaccactccattgctacattgttcctgagccaagtgtcctggccaccatgtctctgggacagtgagtgacattatgaggtcaaacaaggtgtcccccatagaccgtcaagaagacaggctgctgcttttcagggatctctactctgatccccttgggatagcttctaggttcatgagtaggcagaatcccactgagttcctagttcctctttgacccccagagcagcactttagacataaagttcatctatgctcaggatgacagccaaccagtagctccaaagtgttccttgacaatcattttctactttactgaacagcccaccttcctctgcagcagaccgcttctttgctggagaggctgtgggctggggatatggagaacaaactgatgagtgagggatgtgtctgcagaatcagtcagtggaagagatgacctccaggagactgtgatttccttggcaaaggtactgcatttgcttgcttagcaatatctgtgaactccttgccatagaacagcaagaattcgcaacattccctgccagtggcatccttcagcactgccagccacatgtcctcaccagcaaggtcccatgtcctcaccagcaggtcccatatcctcaccagcaaggtcccatatcatcaccaccaggtcccatatcctcaccagcaaggtcccatgtccccaccaccaggtcccatatcctcaccagcaaggtctcatgtcctcaccaccaggtcccatatcctcaccagcaaggtcccatatcctcaccaccaggtcccatgtcctcaccagcaaggtcccatatcctcaccaccaggtgccatgtcctcaccagcaaggtcccatatcctcaccaccaggtgccatatcctcaccagcaaggtctcatgtcctcaccaccaggtcccatgtcctcaccagcaaggtcccatatcctcaccagcaaggtctcatgtcctcaccaccaggtcccatatcctcaccagcaaggtcccatgtcctcaccaccaggtcccgtatcctcaccagcaaggtctcatgtcctcaccaccaggtcccgtatcctcaccagcaaggtcccatatcctcaccagcaaggtcccatgtcctcaccaccaggtcccgtatcctcaccagcaaggtctcatgtcctcaccaccaggtcccgtatcctcagcagcaaggtcccatatcctcaccagcaaggtcccatgtcctcaccaccaggtcccgtatcctcaccagcaaggtcccatgtcctcaccaccaggtcccgtatcctcaccagcaaggtcccatatcctcaccaccaggtcccatgtcctcaccagcaaggtcccatatcctcaccaccaggtcccatgtcctcaccagcaaggtctcatgtcctcaccaccaggtcccatatcctcaccagcaaggtcccatatcctcaccaccaggtcccatatcctcaccagcaaggtctcatgtcctcaccaccaggtcccatgtcctcaccagcaaggtcccatatcctcaccagcaaggtctcatgtcctcaccaccaggtcccatatcctcaccagcaaggtcccatgtcctcaccaccaggtcccgtatcctcaccagcaaggtctcctgtcctcaccaccaggtcccgtatcctcaccagcaaggtcccatatcctcaccagcaaggtcccatgtcctcaccaccaggtcccgtatcctcaccagcaaggtcccatgtcctcaccaccaggtcccatgtcctcaccaccaggtcccatatcctcaccagcaaggttccatgtcctcaccaccaggtcccatatcctcaccagcaaggtcccatgtcctcaccaccaggtcccatatcctcaccaccaggtcccatgtcctcaccagcaaggtcccatgtcctcaccaccaggtcccatatcctcaccaggaaggtcccatatcctcaccaccaggtcccatatcctcaccagcaaggtcccatgtcctcaccaccaggtcccatgtcctcaccagcaaggtctcatgtcctcaccaccaggtcccgtatcctcaccagcaaggtctcatgtcctcaccaccaggtcccatgtcctcaccagcaaggtcccatgtcctcaccaccaggtcccatgtcctcaacaccaggtcccatgtcctcaccagcaaggtcccaacacaagttagaatgtgccatcaggtttcttttatcatttgatcttagaactaaaagggacctcagtggttacctcaagctgttgttctcagcccttggctgttcattagaatcacaggggggtgttttcagaaatacgtatgcctgggccccatccaagaacgatctctgaaagcaggaccccatatcattagtgggtttgttttaaggctttcaggtgttttaatgtgtagtcagggttaagaatgacagctttagtctgatacccttttctcagataagtgaactgggactcagagatcttgcagaatttaccagaaaggtacccatgagttagagcagcagtccacaacctttttttttttttttttttgagatggagtctcactctgtcgcccaggctggagtgcagtggcatgatcttggctcactgcaacctccacctcccgggttcaagcaattctcctgtctcagcctcccaagtagcggggactacaggcacccgccaccacacccagctaatttttgtattttttgtagagacgggatttcgccatattagtcaggctggcctcgaactcctgacctcaggtgatcctcctgcctcggcctcccaaagtgctgagattacactcagaagccaccacgcccagccaatccacaacctttttggcaccaggaactggttttgtggaagacagtttttccacggaccaggattgcggggatggtcttgggaggattcaagcacattacatttattgtgtgtttcatttctattattattacattgtaatatacaatgacataattatacaactaccataatgtagaaccagtgggatccctgagcttgttttcctgcaactagacggttccatctgggggtgatagtagacaatgatagatcatcaagtattagattctcatgaggaatacacaacctaggtccctcgtgtgtgcagttcactatagggtttgtgctcctatgagaatctaatgccaccactgatctgacaggaggtggagctcaggtggtaatatgagcaatggggagcagccgtaaatacagatgaagtttcactggctctcccacagctcacctccttctgtgtggcccggttactaacaggctacagaccagtagtggtggttgggaaccactgagttagaggccaactagaatttgccccacttcattgaattccctactcctttaaatatgcagaattgcataagccaaactccagtgtctttagaaagcagactatgttattgtttcttgaaaagccattcttcctccagattcagatgttggtggtcaaatgagtatctctacagaaaatctctctgcttctccgaattaaactattttcaattatcttgtcagatgaacaaatgtgttttgcattttctttcattttttaaagagagaaactcaagtgaaggagagctactaacgtccaatgaaataaagtatccaagcctgaaattgaagaaaaaaaaatgtaggcatatttgctctttggtttttatttttctgtcaccatctaatgtaatatttatttaatcattcccctaaggcaatgattttcaaactctctttagcagcaaaacttttttttttttttcaaacaaaatcccaggcaggaattctaatatacaaaacagataaaatataattaacagattcctcaggcagtttaaattcttattatttgaaggaaaatgtttgatgccttggtaggactcctgtaccatctcaaacattcttgctggactcagtggctcacacctataattgcagcactttgcgggaccaagacaggaggatcacttgagcccaggcattcgaggccagcctgagcagtatagtgaaaccctgtctctacacaaaatgtaaaaattagcttggcgtggtggcacatacacacccagctactagggatgctgaggcacaaggatcacttgcacttaggaggtcaaggctgcaatgagacgcagtcacaccactgcactccagcctgggtgacagagcgagaccctgtctcaaaaaaaaaaaaaaaaaatcttgttctcaggaacacagtttaagaaccaccgttccactgcatcgttttcctgtcagtcttcagtggccatgtcttttcattttgttttgtagggcaaagacctgctttgttatgcaagcctcttctccgtgaaaatgcatttcatttttagttttgcatatgtgcagttctgtatttggtgtagacagggtcatgtagaggaagagtacagtcactggaaggtggactgtgccaggtgggcatcttcctcaaaagccatggactcagcaccttctgtgtatctgcagccaacacatggaaatatctcataggaaatgaatcagagaagtgtgccctgaggggaagagggagcaattcctgccagggcatgcagtgaatgtttccctttcttgccctttggttcattccccagcacctgtagagccaggaggttgagggatgcttcattttctctctcagtggaatgggacccacagacagctgctgcctaggaacatcattttcctttcaacccaggatcaccctgggtgggtgggtcacatggggcaggacatcagtgagggggacattagtatcagtccaggatcaagaaccacactacctgggatgccaatgggttttggagaggactcttcactcaggacgtttctttcttgttgagatgctattccttattatttttgaactatttccacattcgagttttgcattttctcacctgtttagtaatggtggatggcttcagacatttaactgggaagactctggatgtttagtagacctttctgtcactgtccattaccatagctagtaggtactctctctttgcatgatggagataacatgcaaatccttttagcaaagcatctggcacaaaagagaaacacaaaattgtccgtagaagaaattaatgttagttggaccaagaaaggactttgattatgttttcttaaaaagaatctctgtgttttagactgaaatctttacagatgcaatggcatgtctgggatttgctccaaacagtgcagaatcggggcggggtggctgcggagatgaaccaccaggagcagggagttgaggatctctaaagcctgaagacaggcatgtggggggtattatcctattgtacatgcttttatacatgtttaatatttttcataacaagatgtgaaaaagaaaaaatacttgagaaaacatctatgaaacccaaagcaccatcaaagggaccactcacctgatgagatcagtagacatcttcagagttgttttccccagggcgccattattgcaaggaatagaaacctgctcaaggcagctggagtgaaaatgaggttgttgatgggaacagaggttccaacagacaagaacacagggaacctcggaggattgagagcaggactgggaaaccagtcagcgactgagagcacttcctatttgtcttttgtctttgagtcccagaaaaaaatctcttttgtaaatttttctctcaatttctccattcttttgcttctccatgcatattggatttctctgataatttatccttatccaaatgacaaaaaatggccaccccttgcacaaatgctgggaaacctatatttctcttagttcaaatttatcaaagaaataatcccatttttcatgaatcaactgatggagtggttaccccggagtcaggtaatcagctctgggtccaatcagctatggccaaggaagctaggatcacatgatacaaaatgactccctagtaccactgttttcagcagggactgggggtaggtttaggtccctcaaatgttttatggattatgcaggcaccctgagctatatctactcaaaaccgctaagattttcaggaaagaaatattctaatttgccatttagaaattatataatctctgtcatttggactacagttgagtccactttcctttttcttaggagaaatagagaagaactggttactattctcattgggagactctcaaacacatgtacgttgttttctttctaccttgtgtttttattcttgagacaaaataacccgaaaagttagtgtctacttacagtgctcttactttatgaaagatgtgacattcagcattttggggaagcagagacatgactccgactcttcaggagctcaacaatgggagaggcatgccccaggttgtctgtgtttgagaggcagggaagtctgtgccaagttctttctgttcatggttactggaattctcacctctagcatctgatttctttctttcctgtgtgagctacctcccatgggcattaaaaatcaagtctctgacaccactccgcatcttcaaagaaaacaaatcatttacagaattttaatcagataaagagaggagaaggctgggcacagtggctcatgcctgtaatgccagcaacttgggaggccaaggcaggaagatcacttgagcctaagagtttgagaccagcctgggcaacttagtaggactcccatctctacaaaaaaaaaaaaaaaatttaaattagccagtcatggtggtttaggcctgtggtcccagctaaggcagaaggatcacttgagcctaagaagtcaaggctgcagtgagccgtgatcataacactgcattccagtctaggcaacagagcaagatctgcttcaaaaaaaaaaggagaagaaaaagatgctcaccaatgactaggactatgatgatctggtgggttcctgaatattctttcatctggctcctgtagtcacttcagggcctgactatgccttttctactgtgacgtagctagggaaggacttagtaggttccaatcatcttgaagacttgccagtgaacagaccatagttcttaggcaagcaaccacaggtcccttgagtggctctgttattaatctgttctgagacatcgggctttcttaaaacattgaatgagctttatgtagaactctgtactgtatactgtttaaaatttttatgtaaatatatatcttatgtatattttatataattagtttttatttttatattatatttcatattatatatgtgtgtatatatatatatatagtgcacacaaacatgatgtggaggctgaatgaaaatgttctcatacgttttcttctaagaactttactgtttacatttcacattttgtgtatggtgtgaggtaggggtcaggattcattgttttctgcagatggatatccaattgatctagcaccatttactgaaatgaccgttacctggaaattaaatcatgtcaaaacataaaagcatccataattggccacaggtacagccttggatgtatgacagtgaaggaaatggttttagaagtggtagaaagcaaattgtcagatatgttgtagatgtacagtacctacaaagaaaggggacacccagagggaatactagccctctcacttactgatgtatttttgtgcctagtggagtctccagcatgcaacagacacaacaaatatttattaaaatgaattgttgtatctttccgccatgagataaatcctaatcatagaagaaaaccagatatctaatgccgctttcccttccaaatgtggacatgataggattgacatcatttgcctcatgtctgttgttggagcataacaagaatgagcaagtgtgtgagtgccaggcatacataactgaaaaaaaaaagcttcttccacaccactcgaggaaaataaaatacatatatacataactacattatatggcagactgtgataagagcagaaagagtcacaggggtttaaaccaaattctccaatttcttagtaagaatttcatatgatacagggcaaaatccatcatcattatccttgctaacaaatactgactccttgttatacatatgccaggctatttgccaagctccttaaatgcattatttatatcagtcacagttgctacccattagactattgggaagagccttccaataagctgtatcttttatgtaaacatagactcaaaaatgtttgcaagttatatttctgatggtctctcccctacccttttatcatcacaaatagaaattagtgagaccctataatttttttaagctaagggccagatgactacatcccagcttttcaagttccatattagttctctgtgaaactttagggttaatggctcgtgaacttagtctagtattcaggtcaaacatgcaactagtcaagcatgcaagcttgcatatgtgcagtcctttaaacttgtcctctgtcacttctttcccatctgtgtctttccagccttctgatcattatttccatcttccatgttaatctaaaggtcaactttctgctcttggaggaagaacatgcattcttggtgtataataaaattcaagtccctcttcctacttgtgattgtctttgtggctcatccaggcagcctcatcctgaatgtctatgatgtaagtcaaagaaaagaaaataatcagtcctgaatttggagggaagagatcataagcccagtacatagtcccaacaggccacagtgattgtgtaaaaatacgttttatatcttgtatttgatttgccacacagtttaacagaaaagtaactttatctattttttccaattaaaggtagtaatagtacaatcaataattcctcctgctctagtgtggtaaattaatgtctttctattgtttttaaatcacaaagtgagcattgctatagaaatgtaaaatggtaccatttcattttaatctatttaattttcctttcttgaattatataatggggttaaaacattgaatagaattaatagaatgagtatttaattaaggaataatgagcttctaaatgaatgctcaaagaaactgcttcatagtttatgcagaaatcagataatgggcttaacaaatactataataattgtgttgaatgttttccatatttaaagattttttttttctgtattctctcaggagtagatttaaacgtaacccagttccttgattaggctacactttgctttcatagtaaatcccaaatgccttcccatggcccacagggccctgcataaggtgactctaccacctctggagtctgatgtcatagagttctctctggctctccccttcattccagccacacccagcttgcctttgttctgcaaagccacctttggctcttcccgccacctggcctttgctcttcctctttcagatgccaggtatgttctcacccccttcacctctctaaggcctcctcttctttcagttctcagggaatttttccctgatgatcctctccagactggatcagatacccacctccacacatacacacacacacatacacacacacacacagactccccaagaactgtaattttatttcttgacaattaacacgttgttatacatttctttcccatctgtctctcctttcagcctgtaatctctctgaggaaatatatcatgtctgttttgtttagtggtgtaaccctggatggatggatggatggatggatggatggatggatggatgggtggatggatgaatggaaggatggatggatgatgaatggaaggatggatagatggatgatggatggatggatggatggatggatggatggatggatggataaatagatagatggatggcaggtaaatgccgttgtggacccatccaaggacatatgagggccacaatgcacatctctgagaattcctagcacatcagcccctttccattctacttgaattcatttgcccacacactaaaaaggtattctataccagccccttcagcaggtgctgcagacataaaactatcagtgtcatggaagaagctgcacaggtttgtctcacttatacatggcctaaatattaattttattaattcattcatccacccatccacccacctacccatccatccatccaccacccacccatccatccacccatccgtctatccatctatctgtccacccatccatccatccgtcccatcttcagacctgctcatgtgttgggcactgtgctgtttactaaggatcagggctgagtcatccattaggcaccattatcacagtgctaggaccctaaaatcgaaagaaataaaaagaacttttagggtaaaataaatttttaattcttttcttcacatcacaaaaataattttttctgagacagggtcttgctctgtcacccaggctggagtgcagtggtgtaatcatagctcactgcagcctcaaactcctacactcaagagatcgtcccacctcagcctcctgagtatgtgggacgacaggcacgtgccaccacacctggctaattttttacatttttttttagagagatgggaatctcactatgttgcccaggctcatcttgaattcctgggctcaagtgatcctcccacctcagcctcccaaagagctaggattacagtgttagaataccatgcccagcccccaaaataaattttttaaagcacattactctattatgataggaggggttgatgaaggcaaaggtgactggggtccaccagccatgacgcagctctgctggagcacagggaagatcagtccatccctggtcttctggaacactcaggcaagtggcagaatcaggtgtcagtcaacaagtcagtccctcttagtcttgcttctgtatggctttgtcccttcacattccctcaggcctcacctctgctgccagatcccacttcctatacttaagatcattcattcattcaacaaatatctactgagtttcttctgtgcacctagcaccatgcaagagactggagataaagccatgaagagacaggtgcacatagagcctccagcctcctcaaatcatgatttctcacagtgttttcatcttggcaatgacactcatctgctttgacagagcaacttctcacttatgcactggacatgacagcgtttctacctgactggtggttcccagcatcctctagccttagcccatttcatgcccacatgattgatacctggttttctaaggtacaggtgtcagaagaaccacaaggacgggttatgagctgacatccactttgataagcaggggcagagaaccagtcctttggctctggaccgcagcaagagggtgaaggaaggactggcctaagccatggggatctaaggtgggcaggagtggcagagcaaagattactggaaaccaggagacttaggtctgatctttgggtcactaaacgactttgggcagcactcttccttcttccttccttccttctctgtgcaatcatcttcatctgtaatatgaagggattagatcacacatgtgtcaccaagccccctcctgactacatggcaggtagcattaattgatcacagcattctttcctgctgagcccagatgtactgcaggcctgtccacaccaggctcaggcagcttcacccattcacaagggtaggtcatgtcattgacacctgcctgccgtccttagactgggactctatcctgcttcttgccccgactacatattggaattatctaggcaggtgaataaaatgctgagtcctaggctttaccccagagcctggggaatctgaattgatctggggagtctgaatctgaattgattccctgactgatgcctgattctgccacttgactgcttgtcccagaagaccagagatggactgatctcccatgcgctccaacctggctagaggaccccgggcagtttctctttcatcagcccctccaaccataataaccataatagattttcatgcgctttaaccctggggaatcctgaattggaataggactcgggaagtttttcaaagcctctgggagattctaatgtgcagacagggctgagaaccgttagtatagttttcttgctcaagaattctatgatttttgtgagaagagaagatagaagataggtagacattaaacaagaatcacacgaatcagatcaaaataattgcaccctggagttgtttctgtgttacagcagcctcagtatcccttctcattcccactattttctagcctccatgcatgttctaagaattttccagctctccttttatggaagacaactcgcccaggtttgccgaggcgcaataaacaaattagttgcagtccccgccctgtcccctgagaggcctcaggattaaggtttatgattaatgatttccaagtcaattaatcagccactgcttttgaaacctcatttctcaaattacttttctttgaacacaagggctttttgatatcaccttactgtctctagattcactttcctactaattgaaattccaagatatttcttctttttgtcagcttattggtgttacttgtttataaaatatttgcaaacacattactattcacctgtagtgtgtcagaggtaagcaccaaaacaatactttatgctttcggctcaaaggaatgtgctaatgaaagctcatgaaattctctatctatgagaaagttgatttttcatttattgatttattttcaccacacctacttgaaacaagaatttgagatgtattacaatagaaacacaggtacatcaaggctccaaacaattcatgtagatgatttcttagaaaatggtttctaagatcatattaaaactggatatggagtgggaaggatgggattggttttcttcattagggaaaatagcagtatctagcagaggatctggggtcaaatcccagtctctccacttacaagtcttaacgcttgactcatctgattatgttgttattttggggaggcaaggctgcgagaacaaatgcaaacaaaaatggcttgaactcaatgaaaatttgtttctcattcaatgatagttcaggacaggtgttcttggccaccaggttgctcccctccatgtggtgactcagggacacaagctcctccttccttgtagctccctgcttccctggggttttgtggtcctctgcattcaggtaggcagagggtgaaaaagcacagagaggaggcacagctgttcttttcaccctcccaccacagagcagcacagcacagccatggtcagtatcattgctgcccacattctgcaggagagaagttagtctcgtggcctcacctaagttcaaggaaagctgagaagaagagcatagtatcttccaaccgtaatcctcttatgttattatttatttttaagtgagatgatgtgtgtaacatacccaatgcaaagcatgtagtaaatgactatgtgttttcaaaatagtgaccattaccatctgctttgtttgcagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaagtaagggtgcttccaattgcctctttctcctcatgcgagcacggagggccccatgaggcagctcatagaatcattgagtttagaaggccacagataaattcccccagtctcctccttctgggaattaacaaaggaaaaggctcatggcttaagggtgcactcgtatcctcagcagcataaacaagcagccataaaacaaacctgttttataggttctaaaatacccaaacttatgtgtaactttaagaaaaccaaacttaagtgcattttttattttgttttcatttttgttttttgagacagtctcactctgtcacctaggctggggtgcagtggtgtgatctcagctcactgcaatctccgcctcctaggttcaagtgattctcgtgcctcagcctcctgagtagctgggattacagctgcctgccaccatgtccggccagtttttgtatttttagtagagatgaggtctcaccatgttgcccaggcttgtctcaaactcctggcctcaagtgatccacctgccctggcctcccaaaatgctggagttacaagtgtgagccaccatgcctggcccaaacttaagttttaaatgaaattctttatacatttgctaaggaattattaacagatatgccaaaatgagatgtgtgaaggtgtttttagagatctgtgctcaaaacgtgggctacgacatgacttcttaatcttccttagtgagctcaattattccttaaaaacacacacaacatagttattggtgtgaaaccctctgtgacccttgctaactcacacactgaccctctctatggcaacaagtagaacaaggaggaaatgtaattataaatgtaaaacctctagctcatgctggtaatccagaaatattagtgggggtggtagcacagaaggcttgctacaggtggccttggtattctgggagaaggcatttctacacagtttcactctttctgggaagttctggggagagtttctgccagagaccaggaccttcatgggaacacattttcttttctagtggatgaagccatttgcctgagcagcagggatcaattgtatttatagtgatagtaccagtgggcagagcagggaaatggctgcccactccctgtgtgcccttggccaagacacccatgttttctgtgcaccagtttcctcatctgtaaaatgagaatgttaatgtaacctccctcttagggttgttgttgtaatccattgagttgttataatgaagtactgtaggctggtggcttataaaccacagacatccatttctcacagttctggagcttaaaaagtccaatatcaaccttccagtagattctgtgtctagtgaggacccactttttgatagatgtccatcttcttctctctctatcctcacatggtagatagagtgaggcagctctctggattctcttttttttttttttttttttttttttttttttttgagacagagtcttgctctctcaccaggctggagtgcagtggcctgatcttggctcactgcaacctccacctcctgggttcaagtgattctcctgcctcagtctcccgagtagctgggattacaggtgcatgccaccacacccagctaacttttgtattttcaatagagacggggtctcaccaggttggccaggctggtcttgaactcctgacttcaagtgatctgcccgccttggcctcccaaagtgctgggattacagatatgagccactgcaccctgccaaatcctgttttgctcatatctattttccttgagctgtagcaaacacattttggggaggcctgagctccaggatatgtgatggagatgtctatttacccaagttttatcttccaaacttcaggtctggaaaattgtctgacagattttatagactcaggactagccacggaggacagccagtggctatgtcattctatgacttttacagcttcgaaagtgcaacagccatggacacagagggccagtgccagggtttcctaataactttgccattgcccaatacattagtgcttttatgtacttcgtgcattactgctagtccccatgaataatatacagtactataattgcttattcatacatagtacattcatatataggagtacattacaaacctagtctacatacacataagcacgtattaacaatcccttaattaactatcgcacatctactgttgtcaagtacacaataaaacctaatccatacgaatactgacccgtactagaaatccttaatattacgtagtacatacattcgttcatcggacatagcacattgcagtcaagaaatctcttgccaacatggatatcccctaccaaattttggcctctgaatctaccaatctccgagaaatcatccccgctcaggagtactaccctcctcgctccagacctataacacttgggggtgactattctgaaactatacctggcatctggctcttacttcagacccataacattaagatcacccacatgttacccttaaattaagacatctcgatggactagtgactaccagcctattaaccaaccttggcaacagagtgagactctgtctcaaaataacaacaacgaaaaaagaaaaaaaagaaaaaccagacttgcaggaaggagccattctcctctccctacattcctgtgctggtccacaatgcagtggctctcaaatgctagcatatataagaatcatctgcaatgttagttaaaatgcagatttctgggcttgccccagacctgctgtgtcagaatatgagagagaggtgtgccaggtggttctgttgttcacagggcacaccacttgtcaaggggcatggccttaggggaagcagtttccatcagcttgtccgccctccctgcaaattccaggggaagaggtgcccacagaggctgatgctcttgctgacttcagctttgctagtgagtggactttctttgctttggaattgggatgcagactctccctcaccccacattggctgcctcccaggtcagtaggaagggccttgagttctatctgtctctcagcacatgtgaggcagagccccagaacaccttctagaagccagctaggccatgctctctgctgctgtccactgtgccagccactggtgcaaccatcagggatgcattctgttgcaagtaacagaatgttagactaatagtggcttaactaatgaagggaatttaagaatttttataactagatgaaggtaggccagtccaggattggccaacagttccaggtggcagagagccagcagtggggtgcctcagatgcttttgacattttcctcttggacataaagtagctgccaaagccccaggcatcatatcttcccatgatgctgcatcctaatgcaggaaacaaggaggcagccaggcaaatgagagaaggtgctcttatgagaccctctcctcttatcggggcagaaaacatcctttctaagggtcccccggccaatttcccgtgatgtttcattgaccaatgacatacgttcttccttaacttcaaggaaagctgagaaagtccaaatctggcctttgggcctttacagtgcataaggcagaggggggctggtgattgctgttgggcagtcaagcacaagcaggtctgccctaaccagttagcaatccaacatacagaagaactatttggagtctcaggatgctgctggtttccagcaaggtcctgccacttaaaaggaccaaatcccagtggctctgacagatgagtgtcggcttcgtctttaaaaccttcagatcagaagcacccttagctgctttctaaaccgattctaaaaccaccagaaagttattctttcagctgaatataatcaaccctacattttaagtttattttctattctgtcctcaaagaaggtagtatccagaaagcatccgttattccccaaacctttcacaggcctaaacatagctattcattcagttctggatcctccctcttccagccaacaaacccaggtcctccatccttcccatgtgggtcaacttttccaggctttaaatttcccagggcagtggtttacaccctctcttgtcacttgaaaaaatattaattgaattgcctctctgtagcttccatcaggagtattttcaatttcctcctgtccctgacacagaggcccagcaacagacaaagcacattagtaagattgtgtgctttgtgagatcttggagggcttcttaatccaattacagcactccgaggggattaggaacagagacccatgtgtcagcagctccaggtggtctggccctgggcatcatacagctggagttagtagatcccaccttaggcaaatggaaataaacattagcatggccctgctcccttcctaaggccagcctcacattgtatggctccctccctcgctgctcccctccctctgtggcttcctgcatggcatagttcctctgaagccagcgttccgttcagggagtgtcagcctgggaacataggagaaacactggggccggggaaatgactcttgcagctcttgcttccccactcttcttcctcaccatcttaacagcttcttgttattgataccaacaccaggcctagctccatgggaaatattcaacattcatcctgtccgctgatctttacaacaatcctctgtactaggattttattgaagagacagctgagacttcaggggaggcagtgacttgctggtggtcccagagttatgatgcatcagggccaggacttgactgccacccatctttctatctaataaaaaaatagggaatttaaaaggcagaaatatccaagaatgttagatttttgcacaatcaaaataatagataattgtgttgcacaagtctagtgctagagaaaagcacaagaattacagtcaattcattcattcattcattcattcatgcaatatttatttagagcccactatggtcctgacactgtgctaggtgctgtgtattcactggtgaaagaaatggtctctgtctgcagcctcccaggcagcttatagttataagagcaagaacttttgctgcaaataatgacatccccaggaaagaaggagaggaggagggagggagggaattgtctccttgggaaaaaacaaccagttgtccccagccgaggaaaaggagctgagcggcacaaattggttatttccaagcattttgactgtctcacttgtcagcagatggctggattccccagaaaccccactatcctcctgcttgtgcatacgtctccggctgtggagaatcagatgtcagaccaaactaggccaagattgtgattagtgctggtgtggggtggaaatggcccttgggggactggggtgctctgcatctcactgctgttcagagggcccaccctcagcgtcgtcatggcccagcaagccaaaggctctgtcccctccaggatcctaattgagatgaatagctgtattttccaagcatggcagctccctggccctggtttgaggtttactttaccgaagttgcacattctggcatcacttgggatggacagagatccattattaggatccatagaaagaaggatagaatggtgaattactgctgtgttacaaggattgaaccgacacatcactgtgcagccactcagcactaagagctttgcatctgttaactcttaaaatcctattactgaccctgctgggagttgttctaggtgaagagaggaagtccagttacaaccaggaagcatctccagtgtgtgtatgtgggcacacactctcccatgtgtggcgtgcttagcactgaatacatgtcagccgtaattattatgaaagtgactttatttgcctaaagacactctgacccaacctgccagattccattcccacctcggtgccagctctttccccagcatcaacggtccttatctctgctttcattttcccatgtccactgcaacctctacaactgttgttgcttacttttagttgagtgtaaatcaaatctcttgacttatttagtcttgtccttcttgcaagaatacccattacggcatgggtctgatgggttagctgtttgttccagtaagcattaggaacttgatagaagcagtatgccctcatcttacctaaatgtctccccatgcaccgctgacagagacccactctgggaaatgctgcacccaccacatcatgtgctctcgtggttgggaaagagagtgacagacactcaattggcagcgccattgtattaccaatgtttatcatggagtttctttgacatcctctggtttagtccacacagtggctgggggaggtagatactatcagccccctttgcaaaatcacctagagtggtcctcatcaacgctgcccattgacactggggtaggacaatccaccattgtgtgggactgtcctgggcatggccttgagtctagtattgctgtcccccgcccggcaaatggttgtagagccctcgagtcaattgaaaatgctcccatacattttcacatgccctcagttgggccagggcccagcggcttaactccatgtggctcagactttcaaatccttttccctacatcatactctactagaaaccatgcacccaggctatacttgaagggacatagagaccctttaacttcatggcaagtgagtgagaaacattaaatataaaactttggttttcctgttccatttgatccactgtgatcacagaggcagggttatcttgctataaagctactgaggattgggcgttggagtctcatttaccagagcccccgtgggtgtcgggggtacggagttacaggttccaggcagggaggctttaggcatcaccattgccagggagttgcctaacgatatctcagagggaggctcactaaggttcaagtcactcactgcccagatcactaaggttcaagtcactcagtgtccggatcactaaggctcaagtcatgtgttgtcattcatttcttaatcaaaaacacaaaaacaaaaaaaaaccaacatccatacttaatctcacattttcatgtttcatattctttatcttaaagatagccccccagttacacaggcttagcctccaaagcccagctccatccctgaaggcccactgttgctcgtggaatttcagaggaagttgatgcaaaccacctgccttttgtggctggtgtgcatcctgagacccttctgtctgctttccagccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtgggtgagtggctccggaaccacagacgggaggtgggcaggaatggcttttcctttccagtcgcagaagctggttgtcaggagcagacaccattaaattaaacttgttaacaatctcagcaagtgggaggaaagcgtcatagagaggaggttgtggctgacggctgcagagggccaggctctttggtgaggatgctgctcccacctgattccagcctgggagaagagtagcttcagtgctgtgttcccaaatgaccagccgggtctgctggccctgagcacagtccttgaacggagagagaagggagccactctgggtgacctcctgcatctcagaaacttgcctactttgtcatcagcactgctttatgacaaaggttttgctaactccgtttacagatacaggtattgtggattcgcagattcgtagaggttcggtacttgctcaagcagcccagcttggtggtagaggaatcaggatggaaacaggacactctgcaaagttcatgctccttctagctgctcaatgctcactgactctgagctgccagaaggggaaggagcaaagtcacttcctggtgcttggaaatagaccattgggattggcgttctgcctgatgaggggcaggcaaaaattaataataataatgtcttcagaaatttctgtcttcatttcttaagctctgcccagtgcttagatagaaagcattttcgtaatgagatttaattaaatggtcgctatccacccgtggtgcatctaatgctcacaaataaaagatgccctcgttggtacatggtttcacaataaacttaaatcagcgtgcagatccaaatgcacgcctgtctctgcagaagaaagttattaatgttcctcctccaaaatctaatcttcttctcatatgaggtacaaataatcaagtattggacacacttaaaacgaacatgtgtctgattttcctgatttgaaacacctgaaaatgtgcaacagggactgagtcaaccactttactttagagcaagccggtggagaagaagcagaagttattttccaacaccaaaagtggatttatttttacggctaagctttctgaatgccagatgaactagacaagcgtgtgaaataataccaaatcctataataatgtgaatctgaaatagccattcttttttttcttgttgctatctgacaatggaaacatgcaatttaaacatcaaagagagagtctttcttaagtacttagatgggaaaactcgtagcttaacagactacaaggtagttggacaaaggtaggatgtctccaggtgagcttaagtgtcatcttgtatttctacaattggaggtgaaagcagggaccctggaggcaataaaatgagttaaatcaggttgatgttttggaccctgtgtctctgccattgctgggacaacttgggatgctgccagtcatgaaagagctaatgcaatgggtaggggtggatggaggtgtctgggacccaggactagatgtcctactaagatgggacagacagtgggagaggaaggtcaggctgggttgtttgattaagaccagctctgctgacttgggcaaagaaagaacgtgctggaggaccctatggatactatatacgatggaggaatatctgaagaacccgctcgagatagcacaggagctagggcatccttcaggctctaggtcacaggaacagacagacttgcagttcaggatctcacagtgagaataaaccagctccagctgttttccattctagtgtcactcggcccatggtcacattcccagggcagctctgccttgctggagctggggtcatgcacctccctgctccaggcaccttggctagtgatcaaccgggatgatgttcccagatacacagcacagagggccgctgactgagaaggagggatgaacatcctgtctggcaaatgaagcttactgctgggagtatggaggcagcccataggtgcagtcccagcaaactgagttaggaacaggattccagcctggggagggaggggtgcctgggagagctgagacattaaggaacatccaggccaagatttgagccatggggagcaaaggtcaccttactattaaacagcacaggcagataagggacttcatcctaccgctgtgtgagagaagaaggaggtcagagaaagcaacctagaaatgacttgaggtggcacctgtggggagaagctggaacgcagaaagttctgaggatcttcctgtttctctagccagtgtaatcatcacagctttggccttccatcacaaatgactagtacccaactcacagtgacttatgccaaaaggggtcctgcttacttgcataggtcagcgcacctaatggaaaagtccatgggaacaaaggcctccagcatgatggaattcaggtgctcagaacatattccttctctatatctggctctgctctcccctgggttgtctccatcctcagccatatttgcacatctgtagagggaagagggaagaggcaccagcaaacacctctccttgatcctaccagaggaaagcaacatcttccttcctaatcaatagcccagcccaaggcccaggttgagtcacaagcacaactctctgaaccaagcagaagatgagcaggacagattgtgccacgagtcctggtgcctgagcctgccacagaccccagcacccagctgtgagggcctgcaggggcggctacccgaggaagtgcgggaggctagtcccagaggatgggaacaaatgctgtgtaatcaggaaccacagagagcccctggcccaaaggtgaaccttgtgaaccccacagaaaatagagctgcagtgtgtctctgcagctggtctaagagttctagcatttacagattggcctagctgagtgatggcaggaccaatccctttcccagccgtggagcaaagtaaatgtgtgtgtgcatgtgcatatgtgtgtgctgcacacatttctctctctggcctcactcctcaggcatattccttcctgctgggagccacagcggcccacacgtgactctttctcagcctggcactggctggacaccccctttcccctcctccgttcttctccccttcactccctcctacccacctttccctcctttctctttcttcccctccacccctctcctctcctggagtaaagtcgggataacatcaccgacaggttgagctattgtcatgggagctctttgggaaaaagaggctcattaattatttgcagcctttgatcctgcacactgagaagtgctctcccttggggcctgtgtgtgcagaggaggagtggggctgcagagaggggccaggatgggagacacttttctaatctaatcatctgcgctgggctaccccggcttctcagacagatgcaacggccttccaagttgtgatgttactgctgttgtgatgattcttcagggagcaggcactggaagaagaaacttagctggaaaagaactcttccttcttctcctcctcctcctccacaaaacaggaatcaggtgtctcctgataacattttagtatctctaatatctttttcttcttcttccttgtgttgactgctgatgtgatacctctgttcttgtcttcttagtttaaaagaatttaaacaagagacacacaccaaaagaagtgcagcatagagtaatctactgcaacagaaaaagaatatgttgaaagttaggtgcagaatagcagtatcctctgagagagatgattccgggcaggctgctcacaacaatgaggcagcaaagacccacaccagggaggctcccttctgggagtcttccatgattattcataaggaggtgggaagaggcgttactaggaagctgttctgggtggtcttccgggtgcacatgtgcagcagctgtacaaggtcgttcataagtcgcatgtctctttagcatctaaaatctccacccagggctgtgtttttcacaattatgatgagcagagtcagtttgaggacaggtaaaattaaaatgtgcatgttctgtagaggggaaagtcgccactgaagacagctttgcttgaatgagctcactgactgtgcgcatcctgagattgactgtgttggctgtgcggtcaccacagttgctgctgtgtcccgagaacacggtcacttccttaactacctatccggcctcactcctcctccttcctctgtctctttgcctgtctgtctctctgctgctctgtctctttttctctccccaccccaccatctctgtcttttctgacattccctgtgactcagctccaacaaccccatctcatgtcacattagtcaccaggccctcgaaactaaaagcccccatgagagaccgggaccctgagatcctgcagcagggcctgcccatcctaatggccactgtcacctcctccctgagggggctccttccatggtcaacatgggaagccttctccccaaccccaaccccactgaaacttaggaacgcacttccagctaagtccaactcctgggccacgtcctgcctcgcatgaggaaatgcacttctcaggcaccactgctcctcggctgaccgcggccagacaccctttcatctccccagggaatgctcaagtcagcaaagggcgccttgatctccaaggaacctgtgactacaaagacaaggggtgtccaaacatcagagggaatcttctcactaaaaagcctgggttattaagacttgttaaaaagcccttcacattgtgttgttagtcaaatcaaaatgaacagcagtggtctagtgacagatgaaattcttctttttaatgacttttatcttcttatccttattataaagttaagatagtttctggaagaaacttttgaaaagacaggtaagaataaggaagataataaagtatctgtcatcatctcagacaaggaaatcccttttccacagcttggatctgtctccctcaatcacgtatgtgagtattctgtttttcattaccaaaattggcttgcattatccaccctcaaacctcaccatttttatttcccagtatacgctgaacagctttctgtcccaagaaatagccattatttttcgtcgctgaatagtgtgctattattccattacagggatatactcatctgtttatttattcccttgttgttgactatttacattgtttacacttgtttgcagttttttaaaacattagtgggtatgcttatagtgaaattgtttaatgcatcattaatatcctgaagacaagtccctgaaaatactttggttgagcaaaagtattactgtgtattgttaatgttttttggcatatacagaattctttgtttttatgtctaggcagtcaaatttatattttccatcatttctaaattgatgtcacagtttagaaagtccttctcctctccaagatcatgtacatcaggttctaaaacagatcaggttcccactctgtcgtctccaggtgagatgatgataagacttgcttccactttcagcgtagcaaccgttcctccaggtgcacaaggtaaaatatcctgatgatattcgagtatctctaatgaggagaggacttatgtaactgaacttgttagaaagagtaacccaggctgggcacagtggctcacacctgtaatcccaatattttgggatgctgaggcaggtggatcacttgagatcaggagttcgagaccagcctggccaacatgacgaaacgccatctctactaaaaatacaaaaattagctgggcatggtggtgtacccctgtaatcccaggtacttgggaggctgaggcaggagaatttcttgaacctgttaaacctgggaggcagaagttacagtgagcagagatggtgcaactgcactccagtgtgagcaataaagcgtgactccatcacaaaaaaaaaaagtagccgaaagataattatgcaaaatggaagtaactacatttgctaaaccttctcctacagtgaaatgaaacatgggaactaacgcttccatcagatccctgatttggttacattagggaggcagccggcagctaaatccttctgaatagctgggaggactcacttctttctctctacaatcaagggcaaccaagtagcaattcctattccaaacatttttcagacagaactcatcttgcccaggatctatagtaaacaattccacagcagagacttctgcctacactttgaatatagaagatatgtgttgaagaaaaatattgttcctacccatgtaaaatttcatatcactgctcaacacttttttttggaaagggtcattcatccagggagccctgcgagtatatgtcaagcattttatctgtggggactaagtttggctgaacataacaggaaaattcaaaatgacagtggctcagagcagacggaagttgattttttttttctcacataaagtaggtctagagcaggcatgacagttcagggacagtggcagccccacacggccccacacagggttctacttgctcactattttaccacgtctaggctggcaccctcttcctcatggtctgttatggttgctagtgctccaaccttcatatctgcattccagacagcaggatgggaaatggagaaagaagagggatactccctctcttttaaggagactttctggaagtcatccacatttttatttaaattttattggccaaaattggtcacagggccatacctagctgcaagggattatgggaagtatggtcatttgactgggaagcaatgtgcattgttttttaaaccaaggttcttcactaaggaagaaaggaagaatggatagtgtaaggtagatggcactttctgccatgaatgcctttttaaatggaacctttctgcttaataaataactacagggtacattttaaaagggaaaaatatcccatgatactagatatttgcataatcaaaataatagatgatgttgctaaagactagtgctagagaagagcatatggattacagcaattcattcattcatgccatggtatttatgtagagcccactgtgggcctgacgctgtgctaggtgctgtaaattcactggtgaaagaaatagtctctgtctgcagcctcccagggagcttatcgtcataagagcaagaacttttgctgcaaatgatggtgtccctataaaggaagaaagaaagggagagaggaagggaagaaggaatgaaataaattgcttccttgggaactaagaaccaatgatcccaagtcgagaagaaggagcagagtggcacaaattgcttcttcccctgcaccatgcccggctgactttcagcagatggctggattccgccagaaaccctgctttcgtcctgcctgtgcacaggcctctgcctctagggaatagggtgccagaccaaactaggccaagattttcacaacgccctgcagacatgggttttgagaatgatggtaataatatggctactaggatgattaaaatacctaacatttttatgtagaactttaccaaaagcactgttaccagtcttcttgtattttcataaccaccctgtaaatgagaacatcttgttctccctttttactgatgaggagagagaacctccctgagccgtggttaaaggaggaaagcacacaagcagggtttacagaggctgagttaatgtgaatcagaacgccggagcttcctccgtaccactgcgcctactgctgatgttggcttaaggctttttgaacatgtcttagtgtaacttcaccaagcttcacacttcctcaatccttgacatcattgtccatcttcccacgagactttgtgctcagggagagtaacaatcatctttatctccttccctaatgagccaccagagcttcctcagtaccattgagttagttaagcactttaggcacaggactaagaccttcagactttccacgggcctacaaaaatgtcagggacctgaatacatagtctattgactccaaaattcaaaaagaaagcagcaaaattgaaattaataaatatcaactgcccacggcatcatgacaactttagcaggctaaacctaatatttgcaaaagtgtctttacatttgcaaactatttgtagctctcaccttgcaagaacggtggataaattataagtgattattagcagaatatttcttatggcacagtaattccaaaagcaaaagtataaaaataatttcaaacatgtgataggaaaaaaatgtatttttagtgtgggtacattttagtacatttgatacagtttggggtgaggccaccaaagacagagaaaaatttttaagggctcaaatgtctggaaacagcccaatcccagcataaggactggtgcatgaccagtgctcagtaaccaggtggaatagattaatggcagctgggttgggggtgactgcatgcacacatttttctgcattaagtagacatgggttgaccgaatgcggtggctcatgctttgtaatcccagcacttcgggaggccaaggtgggcagatcatttgaggttaggaattcaagaacagcctgaccaacatggtgaaaccccatctgtactaaaaatacaaaaaaagttagccaggcatggtggtgcttgcctgtagtcccagctactagggaggctgaggcaggagaatcacttgaacctgggaggtggaggttgcagtgagccaagatcgtgccactgccctccaacctgggtgacagagtgagacttcgtctagaaaaaaaaaatgtagacatagcttgcattagtccattctcaaattgctacacagaaatgcctgagactgggtaatttataaagaaaatgatttaattgtctcatggctctgcaggctatataggaagcatggcagcatccactcagcttttggggaggcctcaggaaacttaaaatcgtggcagaagacaaacagggagccagcacttcacatgtccagagtagctgggccgaggtgctacacacttttaaacaaccagatcacgcaagaactcactatcccgaagacgccaccaaggagggattgcgttaactcccctgatcccatcgcctcccaccaggctccaacattggagattatatttcagtatgagatttgggtgaggccacaaatccaaaccacatcataggttttgttttcttttaatcttcaaacattgactaatgtctaccaaccatgaaaacatttacatttggccttgttttaaaccaatcccaggaagggtagccagtgctagcagggagactttagaaggatgtgcaggtctctcacagaactttccaagtccatgaaagttacattgaagagccattgccgtcagccaacccttcttccgaagccttgatccaaattgagcctattctttgaacacagaatatctgaatcagatccaaattagatactcatctctttgaaaactacaactgctttgtcctgatttctttggggctctgtcttttttaagtcgtttccttcctcctcatctttctgacctggatgctttttaactttacagtagaattcattcatgcattcaaactggtaaagaatacaacatagaataatgatatttcagccccaaaagatttgttaaaatgcccaatttccatttttactggtcttcccatgattcatcaagtccttttctttaacaccttgtttaatctaatattggagctcattcaaaggaaatcacaaaaaatgttgggaaattaagcaaaaaccatcattgactggcgatgggacattttattctgtatcttctaagacctttggaagaaaaaggcaaaaatcagctctcttgaaaatgcaaattttgtcatcactggcattctcagaaacacaggggttcaaaaatatgtagtagcctaccatttattgggaggaaggaggatttctaatcccaaaaccaggtttcaaaaccagatttaagagtttaaattggggtgactcccaccttttaaattttaatcagaagttaaaggccaaattgtaacatttctacctggggaaattaagagaaggccttcatcttctaaactatattattaacacttcatcttaattaaatgtggttactgacctcaataacaggatctgggatgaggtcatttttttggttcttgtttttaatgagttaagatttttttcttttttaagtcaacaaacacagagtttgaaatgtaaatggattgtttacagtggtgtctttgtaatttttaattaaagcggtgttgttccattgtaagtttatggtagcaatacattttattgcctattctgctgtggaatttttaattatttatgcaaatatattagcacagatgactcttgtttttagtggtcagatgttctgttatgaagatgctgggggaaacaaagcctcacaaattaaactatgggatttttaaagttttaagggcttcactggctaaaaatagaatcctggcttttataatgatccagagactgaagattttcattattcatgtcaattaaaggtgctcagtttggctaatatgaaacatctggccgtttgggtaaatggatgaaaggctattttacaaatcgaccacctttttaacatccatctacatatgttgttataaatttgccataggccagactttcattattgaaaacatggtttcaaattggctatatttgaatataattatcagggtccttcttgtcagccttagaaattaatcctcagaaccaatatagaaaatattgacaaatgttaatattgttccttgaccaatattttctaagctgttaaatctacttagctttttttttaataaacccatttgaaatagataaggattgctatataagctactaacatagcactgattgaaaaagccacacatttcaggattgcaacagaagtcagttgcatagggaaaatagctgatttattatctgagtttgtctatcaatcactaacaccagtcagccagcaagcacgaggagcttatcatggcattaaccctaacacgggtaatgaaaccacaggcagtgagtcatgtaactaattcaagaaatgcatttcatcatctgctcccaatctgctttccaaatgaatctcaaagcttgtattttcaagtgatgaggctctaaactacagtcctcctacaaatgcttaatttggggatttcctcatgcattccaatagcgttggcaggaatctcactagaagatccgaccttatatggctgcttctaagtattcttgggtccctgagtgtaggctgcacatgtgaaaggaggacctggggatttggattagggctatgaccggaaaacctctctctccattcattcatcccacacctgcaacatactgggtgcttttctaggcattgggggataaagtagccccagaaacaattaaaaatatctgttggccgggagcagtggctcacaccggcaatcccagcactttgggaggccaaggtgggtggatcacctgaggtcaggaatttgagaccagcctgaccaacatggtgaaaccccatctctactaaaaatacaaaattagccgggcgcctgtaatcccagctacttgggaggctgaggcagaagaaccacttgaacccgggaggcggagatggtggtgagccaagatcacgccactgcactccagcctaggcaacaagagcaaaaactccgtctcaaaaaaaagaaaaagaaatctgttatcatcgaaatcatattcctgtggaagagagaaaatgaatgagagaattaataaatacaataagtagcatagtaactggtgattaatgcaaagaaaggaagcagagaaggaaggaggggagccatcactctagatagagggtcagcagaagcctcaccagtgctgtgatgcttcagtgaagaattggaggaagtggaggtgagccacacagctatcccgggtggagaggtccaggtagaggaagcaagtgggaaggccccgaggcagagtgtgcaggattgtgcccagcgcacagcaagttgggggatggtgggaaatgaggccgatgctccggagaagatggggaaagtgttaagcatgctagtgggattaggaaagggggcaattaagggaaagggagacagaggcagagcagaggactggagtgtagggtagccatagtaatccaggtaagaggccatatgggtctgggcagggatggttgcagtgcaggcagtgagaagctgcagacactgaatttgttgttgttgtttttatttttgagacagagtctggctatgtctttctggctggagtacagtgccacgattttggctcactgctacctctgcctcccaggtgccagtgattctcgtgactcagcctctggagtagctgggattacaggcatgcaccaccacacccagctaatttttgtatttttaataaagatggggcttcaccatgttgtccaggctggtctggaactcctggcctcaagtgatccacctgcctcggcctcccaaagtgctgggataacaggtgtgaaccactgggccaggccctgaatgttttgaaggtactggtgacagggatttgctaaccaactgtgccgtgtgtgtgtgtgtgtgtgtgtgtgtgtgtgtgtgtgtgtgtgtgtgtcagagagagagagagaggaataaagattgactccaagatttttgtcccaaacaaatggaagcacagagggcacatctctgagctttgcaagctcgctggagaagtggcaaagtaacttgtgggaggaaagtacaggaattcggtcttgttcttgttgagtttgaggtagacaaagggagcacatgagctgggtatcagggggcgtttgtgctacagatagaagcctgggtgtcatcaacatccagatggaatttaaatccttgagactatgatccccaaagagggaagtgaacgtagggctgtggccaagccctgggacactctcatattgggaggagtggccctgcctggtgctgtttcacatgaggcactgcttcctgagaatccccttacagccttgcaaagaaaagtacatagccagccaggtgcggtggctcacacccacctggcactttgggaggccagggcaggtgggtcacaaggtcaggagttcaagaccagcacagttccgtacaacggtgctgttaacttggcagcccgaccgcaaatcagcatatcctgagtctatgcaggccccagggtagagtgtacattgtccccaggagtcgaacggacctgggccatcctgcctccttccatctcctgtcttctttcactagcatgtctgatccacttccctaacacagccaggctaggttggccgctttctgctatagctacaccaaattgctcaaggttacgatatagtagctggcatttactttgtcccaggcactgttccctgagccttctgcattagatcacccctcatttcacagcaaccctgtgggtctctgattaccccttttatacaggggaagacaataaggattaggaagattcaggaaattacccaaagaaattcacactcagattcacactcaggaaatgtgactcaatgacagccgtcgtcacctctctgctcttctgcctcccaaaccaaactgaagccagagaagcgtgccctgtgtgtgcaattaccagacccaatagcttgctctctccaacttctgtttttcagaataaaattgtttgttccatttctgattttagttgatggatttatgacagctttcattgctgatagccacagcaaaaatcattgctgccagatgcctgtaagagcatggggagggagtctggccagatctccatggactcaaggttgctccctggactcaaggttgcaggaggtccctagggatgcattcttcccggcttgctctttccatagcacagaggctcttcctgccatcatctgatgacagggatggctttgcctgctggacatccacctgttgcacgggttgatgatgcgaaatgtttttacagactccgtctgtcccggtttctttccatttaactctttcatgcccacttccctgtgcattctattcctgtgattgccttaaggagaacaaggatctgtcataaacttccttattttgccaaacttactataggcaaatagagactttcggacttgaaggatgtgttttccttatggaagcaaaggaaactgaccttgactctttttatttcatcctagattcaggctgtctctagaaactaccccagagcagctgcatgggaaatggcagacccctggtctcttacagccttgcaaagaaaagcacatagccggctgggcacggtggcttacacctgtaatcctagcactttgggaggccgaggcaggtggatcacgaggtcaggagttcaagaccaacctggccaatatggtgaaaccccgcctctactaaaaaatacaaaaattagccaggcatggcggcatgcacctgtaatcccagctactcaggaggctgaggcaagagaatcacttgaacctgggaggcagaggttgtggtgagctgagactgcaccactacactccagcctgggtaaccgagtgagactccatctcgaagaaaaaaagaaaagaaaagtacatagccaagtggccacaactgccagactagtgccagacttcctgagcacaaatccccacttgtccatcttccagaagtgtaaccttgggcagatttttaatctctctgggcctcagtgtccccacctgaaacatggggaggaatagtaatatctagattatggagtcactgtgatggatacagaataaaagaattcagggaaagtgtttagaacacagtgcacggtacatagcattaaattaactgattcgcatttttagcaaaatgagcataatgcgtagtcatttactaaaggtgtctctttgagactgataggggtgtttttctagaatatttggttttcatgccttgtggattagtttatttttattttccacaagccagccccgggtacctcactgcttaaatctcatgataacagtctcttcctcattcctggtaaaatccaagggagcagataggagtttctaaatattaagttttgccatctgctgtttgcttgcctgtaagcaagcactcagagatgacagtgccagtgaatgaatggcgaactgctattaaatgtaggagttgaacaactgatttatgaacgtttgcagcttggccctttggtggaggtaggcttgattttgcaatttttctagagcacacatataactagtcatattttctgctagtaaaactgttcctagtttgggcattgggattaaatttatcagtattttaagatgctctgcaaagtacctcacactatgcaaataacaccatgagttgtagatactctgtcacccaaacaagtttaggatctggttgaatgtttgaagtgaaatgaatcagaggagactgttcctgtgagcaaaagaggacgtgacaattcagaacctctaatcatacctagtccactatctgtcaggattcatggtcacaagcaacagaaaccagcatgggctatgttaggtggaataaaacaagaacagacagggttgacattaggcatcacagaatggatagaaaaccagaagacagactggaaaaaatgagtagccgccagatagaactcaaggggagggaaggagggattagggaccaccacaaagagaacagctgagttctcatgttaggcttcccatgcaatgaacatgacctgtgttcacccccacatcactcatgcaagagcatccagtttgctggagttgtctcatgtcccatatctactcctgctgcagtgggagagaatgggagtgggttactacctcccaccaacactgcacaaaacagggttttctccaaaagaggggttgggatgctatgagggatgataaaggatggggagcagtcaggaatgagaaacatccactccaaaacccttccacaagtgtgagtcttccacagtgctcgtgatgacctccacagcagacttgctgttatgactgtccccagctgccctctgtgaggatgggtgcttatgaggtgagaggtaaacatttgcatattcagttcccacactaaagagtgtctctgtcacaaagcaggaacaggtgacatgggccagcaaccaggtaaatctctgcagggcatgaagagccaagaatgctacagaacagggctgtggcttgcagagggcagggtgtggctctgggcagaccatcagggcaagagaaggcactctgccccaatacctccctttgggctggactagggagagtcaagccaggccctcatcttggtcataagctttaaggggataccgaaaaactcaatcatccagatagatgttttaatgcagtattttaaaaatcaaaactaatgcaaaaattagccaggcacggtggttcacgcctataatcccagcatttaggaaggctgaggtgggcagatcacttgagatcaggagttcgagaccagcccggccaacatgatgaaaccccgtctctattaaaaatacaaaaattagccaggtgtggtggcgcgtgcccatagtcccagctattcaggaggctaaggcaggagaatcgcttgaatccgggaggtggagattgcagtgagccaagatcatgccactgtactccagcctgggcaacagactgagactctgtttcaaaaaaaaattattgcaaaaattcataataagcaaaataccagctttttaagtaaagcaggatcattgttactgatttttcattttgtgtccagctcacatatgactcagcatggcgctgctgtgcgcaagctccttttcctctttgggcccatttcttcttctgtaaacttaaataggatcgcaaatgctgtgactctgtggatccctggatcaagagtagaaatgagttcaacctgcgtggcagatgctctgggccaagcctgtgcctacaacctggtggactaggcgaaagcaggtgccctttctgcaacagacagttagcaatgttgagtaaactgtgaccctttcacccatggaaacccacagctaggctccaaagaaaaagaagataaatctctgaatttaacaaataactagaatataaaatagttatgtttaaaatgattaggggaaaagaataggggccaggaagaaaggataaaacataatgaaatagaaaaggcagatgtgaacagtaactaaatagaaagtctagaaatctgatagagcattatctcattaatacttcggacacaactgtgagatgggtgtgatcatccctgttctatagatgaggaagggaggtcgaacctttcgtgagtgaaagagacggaattcaaatccagatatatttatgccaaagaacttttttttttttttttgagactgggtctgtctgtcacccaggatggcctgcagtggtgcagtctcggctccctacaacctctgcctcctgggctcaagggatcctcccacctcagcctcctgaatagctgggatcacaggcatgcaccaccatgcccagctaatttttctatttgtttgtagagatggggtttcgccatgttgcccaggtggttctcaaactcctgggctcaagcaatccactcgcttctgcctcccacagtgctgggattacagacgtgagccaccacaactggcctcaaggaacttctcaacagggaaacatttctttcctttgttttgcaagagaaaacactatttttttaaaaagtcatgctcagtagagtgtgcaggttcgttaaacacctgtgatatctttttataattctgtgtaagatggggtcttcatgtgcagcgggcccatttcatctctgttccccattcattcatgttctttgtgtctggggcttcttttgaaatctgtaaaggtgggaggaccagggaatccaatagagtgagcacatgaagagacgtccttcaagcccacactggatccacctggaactcccaccagggagttcactgggagtggggacttggcagctgccagggagaattcttaggcaagtggttactgtttgatgcttcaccctaaagttataaagatgcaacattttacagctcaacaagtaaacatttcccaaatacttaaaacatagattacctagtcactggtaaaacacagcaactggccttcatctccaaaatatatctagaatctccgcagttcttgcaactgcactacataaactttgtctaagccaccaccatcgttcacccagatgacaataattgccctaacttgtctcccattcttacaaggcaccatccacatcgcggtgatcctcttaaactgaagctcagatcccgtctctcccctgatgaagcccttcagtgcctcccatttcacactgaagtaaaacccagaccccctgccctggcccaggaagcccctggctggcctcggtgctgagcttcctctcctctcgctcctctggcagtctctcctccaaccacacggcctttcttcctcaaacttctttcccattcaggaactgtgcaaacatcattccctctgccttgaattccagtcgatccttattattcacaaattccatatttgtgagctcacccactcaataaaatgtatttgtcaccccaacattaatactcatggcgctttcatggttattcttggaggagtgcagaacagggaaaaatttgagttcacctgacgtgcacattcacagttgagctcaaacaaggccttcttttgctttgccttcttatttcagctctcatagtacaaataagtgccctttttgtgatctgtttagtgccgtgatttttatttttgcacgttttgttcgcaattttgctgtttgaaatggcgttgagcacagtgcggaagtgctgtccagcgtctctgggcacagaaggctgcgccatgccttacagaagaaacaggtgttaggataaccttccttcaggcatgagttacagctctgctgaccgtgagtgcaatgttagtgatcaactgtatacgttaaggaaggtgtgtttaagcagaagtgcacataagataaggccgtgtattgatgagttgacaaaaatgttgtgaccagaggcttgaggaaacctaaccgtgtattcttcccgagagcaatggtttttgagacagagtctcactctgtcacccaggctggagtgcagtggtgcaatctcggctcacttcaacctccacctcccacgttcaagcaattctcctgcctcagcctcctgagtagctgggattacaggcatgcgccaccatgcctggctaattttgtgtttttagtagagatggagtttcaccatgttggccaggctgatctcaaactcctggcctcaagtggtctgccccgcctcggcctcccaaattgctgggattacaggcgtgagccactgcacccagcctacagtagttttataggacatagctatggtgagtaacaaagatcaagtgtgcttgcttgcctgaacattcactacctgtctccccacactaaactgtaaaccccttgagggcacggaccatgttggtcttcaagtgggcctggcaaataataggcactcaatacatgtttgttagttaacgaatgaattgcaaataaattatttccaaagacagtttttaaccaggctgtactgtacaggactgtagtgtgtcctgttcaggagttaatatttaatatgtctttgcaaaggataacaaaggatttccatcagggactgactttaatataaagagtgcaaatgaatgctaattaaatatcttcacttaattattatttgatgcacttccttggtttgggcctcccctttgggcttaaaaagatacaagaaactgcttctgtttctttactttctcccagtgtcactgactaggcaccgttggctttgatgaacctccctgaggccaccatggggagatggtgttgcctggttcccagtgctgaggctctcaagacactgctttcttggaaagttgatgcggccaggagcatctgttttgtgcttcctcctgggcagacaggggctgctcttggaagtccattctgcttcttgctaactcacacaggcggtatgaggaggatgcttagccctaactgatcttatgatctagcctggaacactgagagctgggtttgctaacaagccgggtcagtaaccccaaccttcttacttcagtccagcgtcttgccctgtattgtcttctgttagagcacggttggcaagtttcttctataaagggccagatgataaacaatataggttttatggaccacacaatctgtgtctcagctactcaactcgaccatcgtaatccaaaagctgccacatctgtgaataggcatggctgtgttccaatagaactgtgttgacacagggagtcagagggccagatttggcccatgggccatagtttgccaacccccatggtacacccctaccagcattatggtatcttcatttgtgtgtgttctactctgtgctgcgagctctttaggggaaggcctgaatctcatccagtggtttcctctcaacatcttgtgtagtgcctgccccgtgacaagccctcggccaatgtttgctaaatgcatgacttataagacatggcccccaaagcacgggcattgtgaaacatgctaaccagatgaaaggtgacctaagccccagtggcagcccattcatcatcattctgcctcctgttgccaatattcaaaatagcaccagttgtttttctgtcaacaaatcaaaataatattcctgcatttgttcaacaaacagccactgagtgtgggagcagcatccagatgtcagctgggatctgcctgcctttgagaactaaataaatatgtgataagttgataagtcctgactgcatgccccgtagcagcccagaggcttcccaagatttctgcaaattccagaggattggagaaggaagccttgactttccagaggtcacatctggcttcaagcttccacttctgcaagctagttccatttcttagctgtctcaatctcctgcctgtgccagcctgtggcatcccatgtcgcccttctccccagtcctcccttggcacacatatgcacacacacgtgtatgtgcacacgcacatacacacacactcactgtcatcagaattggttgcatgtgatctaactcactgaggatgtttagaggcatggaaagggcagttacatcacatcacatcaaacaacttcaacctgagaccctggaaagccctcgattttccatccttctcagcatcccatccgtctgtatttctcacaaggcacatcatcccagcatgtacccagcctcagcacatattgggactcttctctccaatttctccctctcctctgcactttctctttttaaacagctccatggagatgtgattgacatgcaaaagtgcacaagttgatgagttctgacatatgtgcactcccttgacgctatcaccgtgatctagatcgtgcatgtgtctagcatcctcagaaacgtcctggactcctttggcatcctcctttctgcccctcctttcctttacctcagccccaggcaaccactgatctgccttctgtcattgtagattagtgtacattttgtagagcttcatataaattgaatcataaagtatgccctcttttttgtctggctccttctgctcagcacaattattgtgggattcatccgtgttgtcacctgtgtcaccagttacacagagacaaagaccttctgcagaaagattcaattctatgcagtccccacctcgaaagaacttcagattcccttttaacagacggaaacatgccagaagaccaaaagggctctctgtctttagaaacccatggttgttaaatagccatttttctcccgattaaaaatagctatttttcagttgcctcagcagctgcttaataagcacctactatgtgccaggcactgttgttagggacagagtgggaatcaggaaaacatggccttcctcttggggaatgatcagagaatgggcaggtgaactgctaaaaagttgcaacaggtgtacatatatttcttttgtttacaggttttgggaatgcaatcccatatttcctttttttacacattgaagtacttttttatgagcaatgcatgctcgtcacaaaaaaattaacaaacatggagcagcataaagaagtaaattaaaaatcacctttaatcccactgcccagatatggccaccattatatttcattttgttaattccacaggcgaggagtagaggaatatgttttgtttcattttgtgtaattaaacgggccacgggaactactatcagcttcctggggagctgagttgtgtttattttttttaagagctactaatttttgattaacaaggatgaatgtaatgtttaagaggaatctatttacaccctcttccccttctcaataaaacaacattcttccccaccaagtgtggagtcgagactctgaggatgtatggccctgagctgggggattctagggacatttttcatgtcactacctagacagtcgtgtgagtgctccagcagtgagggatctcggctgcaggttacattccttgccgaagccagggctggatgataattcactttgtcattacttaattctgtgatggctgaaacgactgagccagaataaaactctcagtccctgaaaagatgagagactcagtgtcaggatgtttaggaacagaaaaagcaagagggcagccgaatggggccatcgggtggctgcataaagaagtctgatgatggatgcagcgctcccaattcatttcttttctaaatgacatatttgtatgtttccttcatcatttcattcggtccacacgtatccatgcggtgcactctgtgtgccagtcatagaggccacatccggtcgtaggccgtaccccatgcacagctgtcctcttggcacagttgactgaacatgctttcgccgtgtgggagactgaagctatatctgtttgagctacaactaaaaccctggagtctctgcatgcctttgccaacatctggtggttccccaaatgtgtcaggttcttctctgcctctgtgctagggtttctaccctgaccgccacccaacaacccctgcgcccttatcctctcttcttcctcaggacgttactacgatccagccccacttcagcaccacggtcagcacccaccaattgcccagcactcctgctactgggttgctaggtatttcgcacatcagcccttctctgtgcctctgcccagtttgcttcctctgccctctctccctccaaataacagctgcctggctaatgtctgcgtatttgctggcagcagagtaacactgaggttgatgtccagctctgccattgagggttgtgggactttgggtaagttacttaacctctccagacctcattctctccaggtgtaaagggagataatacctagaggattaaataggctaatctagcaaagctcttagcacagtgtctggaacatagaaagaacccaatacatattaactattattgtaatctgtcaagaatcatcccaaatataccttgtgctaagaacctttcctcatcatttccttggggtgtaatacaaaaatctgacgtattccagaggcttggataccctccttggtactcacttggcatagcttccatcacactgtattttgtaattgctcatgagtgtgctagttaggataagtaataatagcttctgtgatagataacccctcaaatctcaatggcttaacacaaaactacattgctcactcctattacagtcgaactgcagatggtggggtgggatggctctgctccataacgttcagagatccttggcaccttccatttcatgaggctgcctcttcaaggtgtagcctccagggttgctgtggaagggaaagagagagcaaggagggtcttgcagggggtttgcagccaggcccagaagtgacattatcacatctaccaactttgctctatcctaatctagctgcattagaaactgagaagttcagcccgcctgtatgttcaaaaagaagataaaattatctctgaccacaggagtgcttctcatctccccaccaggccatgagatgctcaaggtcggtggccatgtgccttgggtctcttatccagtgttagctcccttctgcattccctggtcacctccagagctgagcaggtggcactgtggggaggggctttccaagcacagatgataggagatgcaaaggtacagagggtctgggagaaaactggccgcttcagggaaccacaagccacagcaacatttgcttgggctgcacacatattactgcataaaaatagctcgttaccaccttagcataggatgcatgtggaggtggggcagggatgagccagggcagcccaggagagcagagcttacagtcctctgggtagaggccagcatttctgatcctgtctgcctctgctatggagcctatgtttccttggttccaatggcaaggctaacaagagcgttcctccttgggtcatgtatctctttgaatagagctgcatccctaagccaaggaaacatattgtattgagtagtgctttaaagaacaggcaaggaatggaaattggcataaactttctaaaagacacgctgcagtatgtattaacttttttccaacagtcacactcttccatacccgtaatttcattcctaggaatatatctcgaaataatcagaaatggtgtcaaaaatgtatacactcaggaaacagatttatgtgcggagttgtacactgaagccttatttatggtagcaaaaagttagaaaacagccccagtgtccaacaataggaggctggataaatatattacagagttgccatatgatggaataatatgcagtgattaaaatttttgaagccaggagaaattgtttctgatataaactgaagtgacaaaagtgggacatccaagttggtaaacggtacgattccaattatacaaatcacacgtggagaagactttgaataaaatgtctaaggataggagcgggctttcaggctcctggaattatttggtgatttttcatgttttcttcacactgtcttgtattatcaagttgttaatgttgaacacatacattacttttataaacagaaaagtactttttaagaaacaaggggcaaggagactaagaaaaccatcctttcttggcagactccctcagaggtactatgtttcttttctacagttctctcaggactcaaatgcttgcctagaccaacatgcctctgactccataataggcacgaactcgcaattactccctggtacacaaccttttcagccaccgtaacatccattcaactgcacaaaatatgtcatctaaaacctcatccagataaccctgcacattgcacttttttatatatggagaaatgaaaaaggctttttgctttgtaagttccataaagacatttcttggcatctagaaaatgacaagaacccttcaacccagacttcacctcacacccatccctaactttggttacagttcaaaagtgttcatggaagtttgaaaagtggtttcccttttcacctgaagctgtgatttccagtgtggtctggaggagaaaactgcctcgaaggaagctaagggatagaaaggtgttttcaatgtcttctcttaggtggggttttcattcagtcaggttaggttgttaaggcaagagagataatgaacaaaaataacaatcttaccctcaaagatacaataaaatgcactcatgttctcatttcgatgccagaatatgaacaccgagatggttctccaactcccatgcaccaagccccttacaagcttagactcgggtcaggtcctagaaaagaaagtttagggtgtttagggaaatgtttgcagtgtacccagtgagtggatttaaccaaatctgtatctcagagcaggcaccactcccatatcccaccaggaagccattgtgagatatagtctgcccacagccccgctgccacaggctccaatgccagggaaagctgtgtctccccatcagtgcaattctaagaattaagtactccttccttgccaattacatggtcactatccttagaattgaatttaagctctgatagaaaattgttgaaagccttcagtgctcatttttcaccaaactgaactctataatggtactacaatagaaaaaaaatttccaaagttcaattggaattttttcccagtaacttaataataaggctccaatttcaggaaaatagtttcagcatgagtgaaatcacactgtttgttatgcagcatcaaagctgtcctccaacacagggcagaggccagtgctccctggagttgaactccaacaatcatttaaaaacttttgtttccaatcatttagaaacttgtagatttttctggcaacatccaagaataagttatctcacttagatgagttttctgtgaaactgaagctcaccacttcaagtgctatatctttctatatattgacttcatttctaaaacataggtttccccgattcttaaatagagtatgggaaaggaatttaaggtcatttgaggtaatcattcttataggttaataagtgaaccaagacaatgctttacctgattttgagttttttctgtcttttatgctttcatacaaaatgtcatgctctaatcactaaacctgactccagaaatccacctggaaaacaaagtagacaaccaagctttttgagaattttgacttttttaaaaaaagaaaaagaagcccgggcccggtggctcacgcctgtaatcctagcactttgggaggctgaggcgggcagatcacgaggtcaggagatggagaccatcctggctaacacggtgaaatcctgtctctactaaaaatacaaaaaattagccgggcatgatggtgggcgcctgtagtcccagctactcgggaggctgaggcaggagaatggcgtgaacccgggaggcggagcttgcagtgagccgagatcacgccactgcactccagcgtgggggccagagggagactccgtctcaaaagaaaagaaaaagaatgatattagcaggaagagagaattaagctttattgagcaactactaagtgccaggcatttttctgtgcattttatcatttcatccttcaaacaaccctaaagctgaccttactgtcaagcattcaccattcattctacatctgactctcaggagaagaggagggaatgttgggtcaagtgatccccagggttccttcaagcaccaacaatctctatgtctcccatcctaacttaaattttataaaacaaaggatttgtttaggtgggagagtagataagtctgccctagggctggttgcctctttcagcccccattcatgcataacaaatcacacacaaacttagtgactggaaacaacatcgttttcgtgtctctgtggttttaatggctcaggaatgtgagcagggcacactgggagcagcctatctctgtgcctcaatgtctgaggccttagctggaatccccaaggcctgggagctgatgtcatctgaatgcttattcagttgtttatctggcaattgttgattgctgtcagccagaacatctacttgtggcctctccacgaggcctgggctctctcacaacatggcggccaggttccaaaggtgagcatcccaaaagccagcttgcagtggtttctctttcgccttttatgatccagcctcagaaatcatacagtgtcacttctattgcactcattcatgaaggccgtcataaacgctaacccacactctaggggacaggaactagactccacctgtgaacgagaggagcgtcagaaatattagcatggccatttttggaaaatgctatagagccaaagtctgcatgaagagagaacagattgggaatcagaggtacctgagttcagattccagcttcattgctcattagctctgtggcatggggaaatcagtgaaccctttactgctgtgttatttgtaaaatgactgtgattgctgactgattatgtcaggctatacaatcatttctttggttgcaagccatggaaaccaaaccttatgaagagaagaaaacacatatgcaggcatgtgtgtgcacacacacacaagacatagagaagcaaagaaaaataggatgaagcaagcttcaggaatgccggaaaaagctgcttcagcgatctaggttcctgggatgaatggatgatatttttaggctctcacgatcaggacaaatcagctccaagtattttccatccttatgtctctctgaaaacattgtacgctcccagcatattaagtcctgggtggcctgtcttgagtcggactcacttcatcccttcactataggagagagaggcaccataatggaaagtctcagcaaggctacatgaagaatggggtaaactcatgggaaaatgcaggtgtccccacaaagaaggagaaatggataaacagcacatctactctggacatttgcaggactaagaaggatacaagatggaaagcagaatatgggtgtactgttcccgcttcccaatatgccatgcatgttcacgctccagaacttgactgtcagtcactcttcctaaaatatttcccttcctgcctccacccatcacaatcctgttggtctttctaggtcagtttcaaatactgcatggtccgtaacactttcggtgagtaggaagtaatctctttctccttgaattcctccattctattttataactttcttaggccattattacctccttctttgtcttagccatttccattttgctttatccaaacatttccaaacaccaggcaccttcatctcctgtaacctatctgctctctgtgtactgtcattcactgaatgcttttaagttgactttaatttgacttgtctttcttttaacttagcaataatatctgtgatatgccagctatatttttaccattcactttaaaacaaatattattgaaatgtttaaaataattgctgatcccctgttctactactcttccctattctggctgagttcctataagacagagatcagctcttagattccccgtgtatcatatccctgacatgccgcactgtgctattgatctggtggccgttcaataaaaagtcattgagtgaacaaatagaaagcgagaaagagggaaggagaaagagtgagatgaaataatgaagttaaagtgaactgagtgggactcatctttggtgagagaccctaaaggcaaaaaaaaaaaaaaaaaaaaaagagctgggaaagttgaattttgaggagaaggcaagaatactttattttccttctaccctaatgacaccttctctttggactcatcctcctgtgagttggcaaggggaatggggagcagcttaagcagcagctgccaccatgaccattattcccaagcaacttgcccagggcaccagaaggcatgagctccatgtttcccagccaaggctcttccagccagcagtgctgatgggaagaacaggcaagccagagtgccttatcaagtgcaagactcaccacccatagaggatccacccaaagccaccgggagaaccaacacatccctgcagacgacaaaagcgtccttttgctcatggccacatgccttgcagcacaagctcctctcaaatacttcccaggacctcaccgtaagggacagtcaaccagacgtgtgcttccacatgttcttcaaatgtgtttttcatttgcttgggttcaacctcattataatggcattagccagaggaggtagcatggtggttcaggtttctggaagtggggttaagccagtcctttcactttcttaactgaaattccccaacgcccttggcttactcacccctcagcatgctttgttctctttctgtctttttctgtctaggttctctatcatgagtgtcctcttctctgaattcatagcctttgtggcctctcttcctgctaaccatgctaggctaagtaacgcccacaccgcctccactccccaaagctgtccacatcctagtccttaccttatacagtaaaaaggactctgcagctatgattagatgaaaggtctttagacgaccttagatcatcaggatacacccattttcaccataaaagtccttataagaaggaggcagggccaagcgcggtggctcatgcctgtaattccagcactttgggaggctgaggttggtggatcacttgaggccaggagttcaagaccagactggccaatgtggtgaaacctatctctactaaaaatacaaaaattagctgagtgtggtggcatacacctgtagtttctgctactcaggaggctgaggcaggaaaatggtttgaactcaggaggcggaggttgtgatgagccaagatcatgccactgccctctagtctgggcaacagagcgagaccctgtctcaaaaaattaaattaaaaaataaaaattaaattaaaaaattaaaatggaggcaggagggtcagagtcagagaaggagatgcaatcacaaaagcaagtcattggagccacataaggaagaatccagaggtcaaggaatgcaggcatctctagattctggaaagagcaaagaaacaaattctgccctgaagattctaaaaggaacacagccctgccaacatcttaattttagactctgacttgtgggactataagaataaatctgagttgttttaatccactaggtctgtggtcttttgcatagcagacacaggaacctgagatattaaccttcatctactttctcttccaatctatgagggttcccccagcggactccctctataatcagtacggtccattcagcattcatccatgcacaccccaagttttccactctaggggtgccgtgtgtgcaccatttgagaaacacggcctctgcacaggaattgcatcataatcatccttgcatccaccatgttgcccacatgggctttatacatagcaaacaccctgtaaacatgtatttaattgcatagaaagccagtattccattgccatccacagtgagcctcttaaaatacattcttcatcagacccatttatatttgtccagagctagtcatgcatgatggtaggagaatgaaatgaataattttatttttgccatcaggaagtaaacattttattcatagactttgtcatcctgtgtaatagggtctgagtattcactctgcattttagaacatcagacatatggaaaatctatttgatgtgtagttctcagttcctgaccttatgtctttctcagttcattatttccacctctctctagtcattggatttgtagaaagaacagagatatttaagaaacattattcattccttcagagtcttggatttctccaaatagtccaaaaaatggcctatttttagatgattgaattatactagaaaggtggtgatcttgcccccagatgacatttgtcagtgtctagaacatttcagggggtgcgaggggaatgccactggcatctagggggcagaggcccgggttgctggtaaagttctcacaatgcactggacagcctctctgcaacaagaattatccaaccccagatgtcaggggggacaattgaagttgccgcttctccactctccccaattagaagtatctgcttaggtggagaaatcctgggctggaacaacaggctgcaacttggccaaatgacctctgattaaaagcaagagagctggcttaaaacctgttcaaggccatttcgaaaaacctggaggctttccctgactgcaagcttggtcttgggcaaaagtgccttatgactgctagaaaagctaagagcatctcaaagttcaagtgctggcatggaacttgggctatagcattgcatgctggccttctgcattcctcttggtgcctctttttaagagggatgttggcaaattcaggtgtgttcaagggaggcaacctggaaaaaaaaaaaaagagtgttgcggggagctgaagaaggaggactctggaagcacagaaacccagattcctccagccctgttactgccacttagcagccataagacctcgagaaattgactcaccatctctaaaccagagtttccttgtcttgggaattaacaggaagattgtaatgagttaaagttcatgtgtgaagcgcttagcaccgtgactgccacctctaagcactcaataaacagggctgtttatgcttgttattcggaacgggagagggctgcaactcgggcacctgaggcacaatgggaagtgctggagctggaaaaggaatgagtgatggacagactcgatcatcgttgtgtagcatttgaaggaggctgtctctggtgggctgaactacgatgaatgttagcaaaattctacaggcatactgggactcaacctggggaagccccgcaggctgctcagcatggatcagtgatcctcattctggccaccagcagaggtgccttgctacacgccaccaccttggggcaggtgccactggacagtagcctgcgtggacaactaaagctgtcccttctccactctccccagttagaagtatctgtgacttcagatgcagggagattttgaagctatcccattagaaagtcaatagtctgcctacctcattctttagcaaggatgccccataattaatcaagtgggctgaaggaataaaagcctcctgtgctcattgcattctgtgagcaaacaatagcgggaaacaaatgccagacgggctgtggtaggcataacagatgacatagtaggaattggtttatcttggcatcttggggggctttatcttagtgtaatcagtcaattagcaaactttcctaatggctgagaggcacactggctagcatgtgtgtggttgtttgtttgtttggtgttttggggttttttattttttggtttttttgttttttgttttttgttttgagaaaggtcttactctcttacccatactggagtatagtggcgcaatcttgactcaccacaacctctgccttccaggctcaagcgattctcgtgcctcagcttcccaagtagctgggattacgtgtgcataccactaccacctggctaatttttgtatttttagtagagacgggatttcaccatgttggccaggctggtctcgaactcctgaccttaaatgatccaccgccttggcctcccaaagcactgggattacaggcgtgagccaccacacccagctggccagcatgtttttaggtgcttagtagacattgcattctttctccagggttgccataacaaagtaccatagactgagcagcttaagtagcagaaatttaatttcttacaattctgtaggttagaagtctgagatcaaggtgttggcagagttggttccttctgaggcctctcttcttggcttgtagatggctgtcttctccctgtgtcctcacagagtcttccctctctgtctgtctgtgccctaatctcttctcatgaggacaccagtcatatctgactagggcccactatagtgatctccttttaacttacctgtttaagacaatcatactgtgaggtgctggagattaggacatccacatatatatttggggaaacacaattcagaccagaacaggcaccactaaaatttggcagcaccttttaaaagggccttgaatggaaaggagagaacctgtggtttacaatagccgccagagcactgggggctcttgcgatctcatgagaccaaactccaggtctaggcacacctggtttgggacaggcctgctttagcattgaaaacaggatctttgcccaacaggaaggttggagaatgaggcatgcatctaagaaaaaaatgcaagcaaaataaaaattcccacatattgccttaattgtctttacagaaggaaatatcccagggcaagaatcatcagggcatgctctgcgccctgcatttgatttcatgttttcaggagcacccctcaaggtctggagaagcacaggtgctgtacctgtacaagccagcaaggcaaagaggcctggttgcaagatgtgaggcaacattttatattttacttatgttattcaatttgtctacacatctatccttttctggaaaaagaccatattgccacttgagtttcagtattacagacattgttttcctctaagtgactagactctctgtttagctcgccacacaacatcatatctgccatgtgctgtcacacactaataaaagcatagaggagtatgtaaaacagcattgcttctctaaaaattcagccctattaagtttgttggtacatcacctggatttttattaaagtagtaaaaatgttccgcaaagtgactttgaagtaacagtacgattctgagccacgttaaagaaatgttaaggtggagagctctgttgctttcaaatactagtataattctggccaaatatccctgtttaaaatgatctgagcactttaggccttttactaatgtatggattatagttcaagccagtagctagggagctgtgtgtttgagcctccatctctaccacctagcagcaaacagatcaacctgggaaaggagcagctgcctgcacttcattcactgaggattcttccaaccctctctccgtctaacgggctggggtccttcatggacgcattgatagatgacagtgtgccaatccagcacacaccagaaatggttactccaccagggagctcacctcatcttctgccattggcctcccaccccacatttttccaatgaggttctttgagtccgacttatttttgacaaagccacactggtttgtaatgagcattgcattcttttatacagagttggggagggagggagattttgaagggggaaaacacgaaccaagtaggtagatatttgcatctctcaacttttctcgtcaccaaaaaaaaaaaaaatttcctcttcaaatttgtaggtaaaaagacgtgtttctttaactttacctctcacaaatggtatgttcatctatcggctgggactcttttagttaaaaaggaaacctaactcaaaccagaatgggggtggggaaagtgaattgatgtatctcacataactgggagatccaagggtggatgtggttttaaccagaactcgatctgagggtttgtgggaaatattcaaattagaacagttaagagcagacaccagccaatcaaaacagtccatgccagtgacgtcagccctgcatgtgccgtcagggtggggctatcaggaatctctctccctcttgactgccttcctcattgtcaacattactctcaaagaggctttggtcaggtttcaaaaggccagcagtagctctgggtctacagctccccagctctgcaccccagagaaatgcctgtccagtattctccaaaattcctgggctcatgctcacttgtccagagtagatctctagcccaccctatacccatcgctggccactggccccatccaaaactctggggcagtgagtggagggggggctgccctacgccaaatcaggtggtcttacaggaagaagtgaaaatagatgccgcagaagccacaacaatcccatccactgcaaatcacacgatagtaaatggcactttagaccccttctatagtttccagaaatgtagagaggatcacgttgctttagtgtcttgccccaagtgctattaatatccctgtccctaaaagattgatttttattatcggtagaaatacttaatagaaatgaaatctacgctctcggtcatagatagctggcataaaaattaaacaaaacactgtgaagcatacttctgaagtgaccgcatacctagctatgctgccccagtgagctcaagtgtgttttcattagggcatttggtaagcctgggggaaactgtttctgccccacaaaggaatgttctgcaaacattcagtaactaaccatgtgatgctttctacctctgtaactaaagctaaagacttttacctattgacttggattctcagctatcagtaggagggacagtttcaaaacattgtctatagagactgtaacatatgactatcacaagacagactcaggaactgttgaatattcatgagttaaatgggcaaaatgtttgacatcctggcatctttggatgtgtttgttttacatttagtagcttttctatagaagacagaaatgggaaatgccttcttaatctgcttgaaggagagggttctgatgatactcatctatcttcgatgagaatgggtctttatctttaattcctaattaacggttttgccaactacctttatctatttcccttgtgattttaagagaaaggaaaagtcttgagtgtgttgcctctgcccatctgtttctttacatcatttgcgagctcaggtacttgttatttgctgagcaaggactttccagctaggattggataaagcagtagctaggttcgagagtaagagttttattgctatcatttagagtatttcttcattcgttcatgcatgcctttgctcataaatacccccaccttattccacaaaagatatgaaatggagctttattgctatgagttcatgctggcataaatattaagctctgtgtaataatcacttgggctattcccgtacatagtgcagagttacttatggccaacgcaaagtctattttcccatcagaggttaacgttcccatttacttgatcagggtttggataatgcttcattcacagctgtttttcgcttgcaagaatccatctactttatcctcactgaccttaccctggcaggtggtgccaggatttcctcaggcagttgtttgttttagcattttcgagtatttatactggctgcggtaagggagccaggatcctggggcttgtaagtaccaggtcttggtaagtctccttcctggcagcagcagcagcgttagtaaaatgcattttccaatactatcctgtgtcttaaatggtatttttatccattagagttgagtgcaagcaatagaaattaactctgaagaacgaatgcaaaaacagtgtctttgagggctgtgtgtcgctgacaggcaggcgggtccctcaggggagccctggtggacagtctgatgctcggtgccaactgtcagcccaggccaggagtcagagttgggagagattgtgatgccttggcttgggtcagggcccacttcctagctcggggatggtcaaccttgacaacagcgtgtgacaagggtggagtcatagcaattagggtgtttttaccaaagtgaaggaagacgaaatgccttcctgggtggggaaaaaaacaacagatgtccactaccctccccttttgcagtaattttctctccatatttgatgactattctatcagatattgttaaaatctttccccagtatatgcaatttacctttaatgtcatcttcttggtacagtcttccattttgctgagttcattttgttttccataaagctaggaaaacttagacttgcccacttttttgttttaatagactttgttttttagagcagttgcaggttcacagcaaaattgagcagaaggtacagggagttctcacatgcttcctgcccccacacatgcacagcctcccccataatcaatatcccccaccaaactgggacattcgttacaactaatgaacctaccttgacacgtcatgatcaccagaggccatagtgcaaattagggttcccttttggtgttggaaatcccgtgggtttgggcaaatgtataacagcatgcatccaccattgtaataccatgcagagtagtttcagaactctaaatatcccgtgtgctccacccgtacatccctccttcccgccaacccttgccagtcattaatccccactctgctgtacctcttactggctttttttatgtcttgagtcacagtcttgctctgtcacccaggctggagtgcagtggtgcagtctcagctcactgcaacctccacctcctggactcaagcaatcctcctgcctcagcctccagagtagctgggactacaggcacgtgccaccacacccggttaatttttgtatttttagtagagatggggtttcactatgttggccgggctggtctcaaatccctgacctcatgatccgccctcctcagccttccaaagtgctgggattataggcatgagccaccgcacccgccctggcctctttaatgattgtttacttgggtaggtaaagtcttccagtccttttcattctctctaaaatcagaaactctttggaaatatctgaattttcagatcaacatcattgcctgtaaaactctttaagaccctctttgaaatggggtaacagccattaaaaaaatgagaaggccagactcaggctggacatggtggctcatacctgtaatcccagcactttgggaggccgaagcaggtggattagttgaggtcaggagttcaagacccgtctggccaacatgtctggccaacatggtgaagccccgtctctactaaaaatacaaaaattagccaggggtagtggtgcacacctgtagtcccagctacttgggaggctgaggcaggagaattgcttgaacccaggagacggaggttgtagtgagccaagattgcaccactaccctccagcctggatgacagagcgagatactatctccaaaaaaaaaagaaaagaaagtgaggcaaatgaagacttgtagtgattgctttactataatcccctaatctcccctgacttcttccccactttttgtatatattttccatcttctcccattgggttcagtctgaactgaatctgtctgaactgcctggttcaccgcacgtgaaagtccctgtctccactttcttctgtctcaggaaacaggctcagggcagctgagaaacaggcccaggccatcctgctgaaggacgacaccatcaggaagaaacaggtagtgacatgaaatgggcacctactatgagccaagggctgactcttggtgtctatttcttcatttaatgatcacggggacgctgtgagctcctttcacctctcactgcctcaatttccttacctgtaagtggcgacgataattccttcctccaggactattgtgagagtttgagagctagtttggagaaaaagtaggccaattaaccagctcccctgcatgcaaagcttgttatttctctgtgacagaggcagctctttaaaatcttaccgtgcacgttctgcaggacacctttccctggatttttctttcacgcaaaccccattcagttcctactgtgctctgcttgcctctcctgttgttgagaggctcaggaaaaacaactggaactaattcaccactctggcttgatgaagtcacttcctgctgctctgggcattggcctctggaacaatcaaccgctgtctggtgggaattctattaacatgactgtgactgtcttactttggacagtcttactttggattgcccccgaagcagatgctgagacaagggttagggtgaaaatagtttagttggcagaaaatcccataaaataccagcgggagagcaggaagtgggacaggagaggaacacagcccacacactctgcattgtccatccagccaccactatgcgtacaggagctgaatcccagaggaacacactcctgggcttattccatccaagtaatatcgtaggctgggggaggtccccaaacgccagtgagtccttgaccccagtcattgtccaggctcttgactgtgagaagaaattcaagaatgagtcagaaaatagtgaaagtatggtttattgcaaagcaaaaagtatacactcaagaaaggtgagtgtgagcgttttcaagagtgaaggaatcgctctcaagggggattggggttgctacctctatggatttctttaaccaagcagtggaatgttcatgaagattcctggaaaaaggtggagatttctcataactgaggtgtcacccatttttgcaccaaatatgggtgttcctggaaccatcgaggtgccggtgggtgtgtgatatagtatgttaacgagcatatattgaggtcctagggaaaacctaagtgaaatccaccaccacgatgggtccagttggtcttagccagcttggcccacactcttgttttttcagggtcttatcagcccctagcttctgcagctatttcaacattttccttttgctaatcatgtgaaactactgcctggaattttctattcttctatgaccaccctgtattcttcttgtctcatggggagcaagggagctgaggtataagtaccccagtcattgggtgagggttgctcctgagagaggtgctgattctcatcgcattcagcctgctgcatagatgagcaaaggcctttggctgctggtgcaagttctctggcaaaggaatgcaggtgctgacaggtgcatttggcctgatatgcactgtagggggatggcttccagggcaccctcaatgcctcttaaaatcattctctccttaaaaccagcccattcatctcttgggggcttctgcctctctttcagacaaattattgcagagagtccagtagccaagtagaattgcattgagcaggcacatttgacaatgacatttgattccagaacttgtcaagctttgttctcagaatatgaccagatcctaataatgtctgtccactgttgagggaccactgcgtaccagaccctatgtgggatctgtgaagtctattacctcattcagtcatcccagcaaccctgtgagggatcccccactgtctccaatttctgcactaggagagggcgacatggggaggttacgccacactccacgtcactcacccacggccctctcagtaaacggtggacacaggatccgtagcctgaatgtctgtgtcatggtcaagctccaggtcttttccagcgccacattttccagcacaacaactagattagtaagtgttcgcttatgaggatgtactaggagcgtagctaccgagcgcttcctgcataccacgtgcagttatacacacctcacatgtaagaatttaaacccccacggtgacgctaggaggtatgcacggttacttccattataaggtgaggaggctgtggcataccatgttctgtgccatgtcctcagataccattataccagatgccattccttaagcccctgagtaccaatcccactccctctccatcacacacagccactatggaatacactcacatcagcgtcagttggccccactcactgtggggcagaatttccctggtctgatgcctggcatctgcccagaaggcactgcagcataggggacagtggggtcagactccactgtaggaatctacatctccctgcacacactgtgaggccttgcaagggctactgcacatcagcgagcctccattttcctcatattcaagatggaatcaagcttgtcttcctggcgggttggtgaagatggcactaaatgagaagggaacagggtaggcaccaaatggttgctgctgccgaatttgggaccggggtgctggtggtcatctgagtgccagctctgcctgaccttgatccagtacatacgtacacacacacacacacgttcacacacttgtgcatgtacacatgtgtacatcatgcacatacatgtccacacattcacacaccactcccacatctgcacccacatgcaagtactcatacatgcactcatgcacacacatgcacacacattcacacatgtgcactcacacatgcacacactctccagtaagctttttggagttcatcaatattacacccaagtcagcatttattgagcacctactgcataccagcattatgccaagcacaagagattaggggaagttgggcgtaatggctcacgttcataatcctgctctttgggaggctgaggcaggaagattccttgagcgtaggagttcgaggacagcctgggcaacatagtgagaccccgtctctgtctttaaaaaaaaaagacacaaggggagcccagaaatgaaacagccaatgtatcatttcaggcagaccatctcgttttcacaggaagcagcaaagacagggtgccagacacctttgccacgctccactggcttccatactctgagaaaagagggaatccgactcatgagagccagaaatgaaattgatgcaatcccaaacccagggccagtccatcctggaaggtaagccccatggggccttgtgactgcctcttctttcaagcaaggtcctgtcataattttctccctggcacaacctttatggagtgggttataactgtgcctgaaatggactggcctctggcagagcattcctcggtgtgggagccatcaggccctcaggaacgagtcttcctgccaccaggaggtttcatgtatgcacctgtatcatcagtagtgtggtgtttctgtatcgtcagaactcagcacaccatttctggccagcatggttgtttgatgtagactgagaagtgggttcagtaatgagcacctggcacactcaaactctgctagggttgggtggccacactcctttgaggcttgaccaatgtcacctgaaggtcaccaccagtagccatccagaacagtttaattgggggttggcagtccatctgcagtgacacactgcctgtgtcctccaaaactcagtggattggagaattgagtcacgatgaatcttgtaacccatacccagagccctgaagaacgcaggttgtttgcacgcccagccacaaagaagttgccttctcttgatctttgaagcaattaaatgtcatttagagaggagaggtttgctgtttaaaaatattttttaaaacagcttgagtttattcttgtaaggctgccattgggtctgagaccccagaggagcagtgcgctgccttgcagttactccgcagtgggcaagacaggcatgttttgctctgggaagagttgctgaacacctgtctgagcaagggactctttgtggctgtctggtcgttatgtacaccacttggtcctacctccaagtagcttgtggtctcctgggagctgtaagaaatccaaaccagcaaacaacatagtttttgtttccagtgttaaccacctggcgaatggtccagataggaatgctgtagaagctccagggaggaagagactccaggggctcaagtggtttagcagggctagcaggactagcaggacaagacagagtttgaatgagatcgttgcatctaagtggaataaggagaagctgataatgcaagaaggtcaaccatctcacacacatctagggaccgtggggaaacccattttgctagagtagagagattggatgaggaagtacaggctgcaccctggagccaagctaagtaaactggacttcattctgaactgggagtggaggggtccatgtgcaaaagagcactgtgggaggatccaggggacactggagccctggagcttgttaggaagcaagctactcattcccagggaagaaagaggaggactcagagtggggaggagtgtgccacatgaaaggtgcccacagtattcaaatcccaacttcgctgcctgctaattatgtgaaccgatgctggctacacaatctctctgagccttgctattctcatccctgaaatggcaatagtaatcccagcctcaaacaatgatagttaagattatatgaaatatcatgcatgtagtgccagctacatatgtacagtgtccaaccccacaaaggggatccctgttattcgtagggagatggtgtagcagtgttgccctagagccaattcatagcagtttgcaggggccagttgttaccatctctttgtagctgtgcattcagtgacatcgtgggagtaactcgaaactggccacattggaaatacttctatcatggaattagacaaacactattaattcaagctttccccacctccagagaatcagatgttaaacatttgccagtgttcctctggcaaagaaaaggaaaatagccagaggtaagtgaaatcaaatgagagaagtctaaccttgcaaaactgagccaactgcactgatgtatcctgttgtctgtcccacaccctcgcaaggcttttggtctttgtccagcagagtcaccacgtcttattcaggttacagtgctgagctatttggaaaccaggctgggggggtggatttcaatgtcatcttactaaaaaagttcactaatgaaaagtgtattgctaagacagcagcttcatatttctcccagtctttatcagcagccatggattgaatcgttgacttgattttactacactgaggtcccactgaggaaggccaagttcctaaatcatgcacctgacaggtgccatatttctgagcacagagctgagctgtgaccttctagtttcacagtaactagagctgggtgacatgcttaataaagggagtacatggtgcatttttaaaatatggaatgaaggtggaatcatgcagacatgtcagtctgaaactggttaccagaagcaaggtgatcaatcttcctgcctgtcttaggatgctgatgtgagaagcacgatgactttcacttggcagaaggatttggaagtatctgggcttgataagctacctcatgccaaggaccatgctctgtatacgacttcatcttttcacccaccctatgagtgaggttttagtgtctccatttcacatatagagaagtaaaagcttggaaggttagcacctctctccatgtcccacagatactaaagggctgagccaagatttgagtgtgcttttgtctgattcgcctctgcttggccctctgtctccaagctgctgcttagctggaggctcctcagtgacatcagctcactgtggctccctctgcctggaatgttctcccttgcccaggccttcatgtgactgtctccttttcacttcagtctcactatcatctcctttgcaaggctttccctgatcaccttcgctaaagaagccctcctcaactctgcccacctgtcactggtcactccctgtactgttgcccaatgggacggctttcagagcacataccactctctgaagttatcgtattgtgtgttaactatttttatgatctcccttcctcttgtagaacagaagctccatgagaacaggaatttcatgccttgttctctttcatatatgcagagtaaagaagaatgtctgacatataatagctacacaataaatattgaaagaatgaggggatgggtggacagatgcatagatccatggaagaatggatggatggatggatggatggatagatggatggatacatgaattgatggatgcatggatagacacatggatgagtgatgaatgcctgggtgggtgatgaatgcatggatgaatgtggaatgcatggatggatgatgaatgcatgggtgggtgatgaacgcatgggtgagtggtgaatgcgtgggtgagtgatgaatgcatgggtgagtgtggaaagcatgggtgggtgatgaatgtatgggtgagtgatgaatgcatgggtgggtgatgaatgcatgggtgggtgatgaatacatgggtgagtgataaatgcatgggtgggtgatgaatgcatgggtgggtgatgaatgcatggatgaatgtggaatgcatgggtggatgatgaatgcatgggtgggtgattaatgcatgggtaggtgatgaatgcatgggtgagtgatgaatgaatggatgagtgtggaatgcatggctgagtgatgaatgcatgggtgggggatgaatgcatgggtgggtgatgaatgcatgggtgagtgatgaatgcataggtgagtgaggaatgcatgggtggatgatgaatgcatgggtggatgatgaatgcatggatgagtgtggaatgcatgggtgagtgataaatgcatgagtcggtggatgaatgcatggatgaatgatgaatgcatgaatggatggatacatggatggatgaagttgtacaagctcaaaccagctcagattggaggaagcgtcttacttgaagccccctgtgactatgttggggcttgtctcctaccatctcactgaaggagcctatctcctaagctctctcctagacacctgtatccttactttcccctcccttcccagcctgagcagtgtcagcgtcaggagcaagatgattgatgaagtgtcagcagggacacaaccagctgggtgagcaggggctatattgtaacctgcagccaggagctgctcccttgagatggcctttgggtacaactctatatggcttcccagcctttcttccagctgcaggatcatcctacccctgggactcccttattggtgtcctcattaggccaatcaatgcaaattaagccctgattcacagatagtggggatatacagtcaccacgacacatatggcctctgtcatccagtttcactcagtctagagaaagaaagagatgaataaacagacccttttagtataaaagctatgatgaaagtgacatttgaggtgaaaacactacaatataacagcagcagagagaaaggcacatcagtcaaagtcaaggaaggaagggacagctgggctcagacttgcaggtagaccagggcaaggatgttcaggcagaggaaatgggataaacaaaggcatggtggccaagagagctagatccgttcactcaacacacaggcaggactgcaacgggtcttgtgtatcctgtggatctaatctatccttaggcgtcagtctgggaaacatgagttccgtcttctccactaatctgggaaggagggtcaagtggtacctctgtctccacctcctccaggcctacacagtttgtgactgacatactgagcaccaggtctgcatcacccaccttatcacatgtgggcacaggatctctgccgggggcaagcggtatgatgtgtcctggtcacggtctggctggtgatttggttacatccagacacggaagtcgacctagaataacctaagacaaaggcagtcgtttctctggctgacattgtcagaacgttaaacaaccaaaaacagcaacaaagtgatgggccaagcaggcaagtttgggaacagctttaatgactaatttctaatgagagtttcaaaacactaattttccagaacagagaatcaagttgtgctcatttataacccgtcatctgcaatgagacagaggatatttctttctgtgttgtcagttaactttctgagctggacagaatacaaactagaagaggtgggccgtaaatcagctcctttggaactgataaatggatattgtacaaatcctgcatttgcattggctctgaggacataaatcaattctcatgatcttactttggaaaaaaatttccctttgaagtcagactgagcgatttatgtagcattctttcctgactttatttttctcagctttttaatgattgtcttttcactttctgcacttacacaacattgtaaagtgttgcattttcatgtagagaaaactggaccttggtctgaatcttcccacaagggataattttataacttttttgctcagccattgaataacaattgcttttggaaagattgtcataatgtatcagttagaaggcaccttagagaccatcatttcacatgacctctgttttttagatggggaaactgaggcccaagagtgacagtcatgtgctgcaggtcacaggccaagtttgtgacaagaccggggtgtctgttcgggttttggagaaacaaggaccctagatagggtccattcattcattcatttatttatttatttgttcattctccagacaaatcgttatcttggccccttctgctgcagccattgccactaagaaggcaggccctgcaggggagactctgcacgtcttttgtttgttgagtatttgctaaacgggcaaaaaatggaagaaaaatcaaaacatcactgttggctgggcacggtggctcacgcctgtaatcccggccctttgggaggccgaggcgggcagatcacgaggtgaggagatcaagaccatcctggctaacacggtgaaaccccgtctctactaaaaatacaaaaaaaaattagccgagcgtggaggcgggcccctgtagtcccagctactcgcgaggctgaggcaggggaatggcgtgaacccgggaggcggagcttgtagtgagcggagatggcgccactgcgctccagcctggggcgacagagcaagactctgtctcaaaaaaaaaaaaaaatcaccgtccttttttggcgttctgtcagtcaagagtattctgaagactatcgagggaggagtgtttggtttgtgccttgttttgttctgttttagcagccctggaaatcatggatacctcccttccttgaagttatctttcccatgtataacagctgtattgatttatgagatataattcacataccgtacaattcacccatttaaaatatacaattcaatggtttttagtgtagtcacagagttgtgcaaccatcaccgccctcgattttagaacattttcagcaccctaaagagaagccccatcccccttaaccgttaacgtgcttccttctccccactgctctagtgaccactaaccagcttcctgtctctgtgggtttgcctagtacggacatttcatcggaatgaaatcagctaacatgtgatatccttaatggttttgtagcagaaagacatctacgtgggaagggacgctgctgagtgtttagagaacagacacattcatcattttattgtattttctcaactttagaacagttttcaaacatgtggaaacgttggaagaattttatagcaagcaccctttgccccatcaccgagattctcccagcacatcttcttctgcttgctttatttagtgcacacctatccacctgttccagagatcaccactgcggcagtgggttctcaaaggagaaccttccaaccttcccgcattgagaaagaaaaatatcagttttactaaatgaaatatcaacattggagattttataagccgagaatgttagtacatcaacattagaagccctaaaaaataaaattgcattcaaaggccaaaaaagtcttaggcttgctagctctccaggaaaggcctgtgtgttcaggacaggaggactaaggaccaaacaggtttgggaatgacagatcccttgacggaactggctgacaactttgctcaccagtcacagcagggcagcccagggagtgaacaggggcgttggcggggagggcagccattcccgcccgctgctaatgggctcgcttctcaaaggagcttttgggattcaagggtttaagtatcaagtttgactgatggatttggagggaagaattgaaaactgcctgagggaaggcgctttgctttttcttttgtgaggcaaaagcttttgaaaactgtgactgtacaaagagccacagctcctctgaggagtctgttatgcggcaacacatactcagatgtggacagcagtgagcacgctgcctggaaagggggaacagcaccgcgggcaggcttcagagccacacaccacgtctctgtctcagagtctatcctcgaccacagggtttaagtctttgatgtgcacactgggccctggagagaaggtgcctgttctcacgggctgaccccacaagcctgtgagccgtaagcggtgtgattcgctaacagttgaatggcactggctatgtgtgtatgtgtatgtgtgtgcgtgtgtgtgtgtgtgtgtgttgtgaagatacatttagtttgagtccctatgaaacgaggagaaaaggtcttgacaaacaacagttcaatagctcctgccaatatgtgcaatgcaattctttttagtgagtgaattaggcttgataagaactacattaaagcttctgttggaagaggaattcaaaatgctcatctttgtaatttacccactcagtcaccagtgtttaccaagtgccaatggaagcctggagagaagagaaagcaaagataaataagcgtgtctctcggccttcaaagcactgtgcccagcaggaaggaaagcacacaattacgacatgccgtttttattgtatatatgtttatatattaggttgggccatgtgaaattgctgatgtgacgggttttgacgagagaaatggcaactgtgtggttcaacctaatatttagatagtattgtcttagctcaggctgccataaccaaataccacagactgggcagcttgaatacagacatgtattactcacagttctggaggctggaagtccaagatcatggttctagctggttcagtctctggggagggctctctttctggcttgcagacagccaccttcttgctgtgtcctcatgtagcctcatttccttggggcatgtacctggagggtggggattagggagcatacagggtctccttttataaggatcctcatcctatcagatcagagctccatcctcatgacctcatgtaaccttaacttcctaaggagaggcccacctccaagtactgccacaatgggggttagagttctatcaacatccgaatttggggggaacagcaacaaatgttcagttcacaagtataaaatggatatattatttatgtgcatatacatcatatactgttacatatcatagataagacatgcatattatacatatgtgtatgtatatatagtaaatataccatctatagtaataaggtttcacaaagaagagaaaatggaaatgtagagatataaaggaaatcatctttgtattactagtctttttattgccaaaaaaattttatttgcaaaacaaatataggctcatggtaaaaattttagcaactgagataggcaaaactaagaaagatgtaaatcccactagccagataccactactcctaagacccaggtcagacagcgaggcatcactgttaagagcatgggcgctatggttggacaactctatcacttactagctgtgtgtcctggacccagctacttagtccctcaccacctctgtttcttcatctatataatgggtcagtaatcccacccacatgaagttattgttagacttaaataagctgacccatgtaaagtgcttggaaattccctggcacaaagcaagtgctcaataaatattatctgtgactctattattatcatcatcatgatcataattattaccgcaactgccactagcattcccttccaaggtattttctcagccagcagcagcaaatctgtttgggattgtatgtcaagccctgtgaaaaagaagggtttggcacacagggcttcatacaaagaggggttttgaagctgacctggccattgccaagtcattaccgtgcttgtgagaagggggcagcgagcctgccacatgtttgcatgtggaccctcacggtgctatacacatacctacctactataaagatttacttcgtatgtgttgtcatcttgtcatgctgtgttcatcatggcttttaatgtctacgtagcattccattatcacttttgatcaacagttccctgattgattttttatttttctatagtaaacattgaaggagaaaatataattgtcgctaaatatttcagccaaataagtctgagctatgcattattctaaggccctctctcagatcttcacaatgcaaatctgagtattaaaggctctgagaattcttgcgcaaagggggacctcatttgatgttattaacctggcattccccagttttggaatgtgctccctatagctatttctttaagctaaataattagaggaagaatttctgggtcaaagaatatgtacagttccaagagattttcatttgtttccctctagaatgttgttttaggaactgacaaacttggagatacctccttctgggctaaactgtgactttttaaaatcacaattcgatgaaaagttcaacacactaaaatatacggtggtattcttttaaaaaattcatacaattgaactgggtacaaaggatcacctgggttttttgtttgtttgtttttgttttgttttcgttttttggtttgtggtttttttgagcttttagattcagggggtccatgggcaggtttattacctgggtctattgcgtgttgctgaagtttggggtatgagtgatcccatcacccagacagtgtgcatagtacccgatagttttcaacccttacaccccttccatgctcccccttctagtagtccccaatgtctattgctcccatctttgtgtctgtgtgtactcaatgtttagctcccacttagaactgagaacatgcagtatttggttttctgtccctgtgctaattcgcttaggttaatggcctccagctgcatccatgttgctgcaaagaacacaatttcatcctttttcacagctgcatagtattccatggtatacacgcactgcattttctttatccattccaccattgatgagcacctggattggttccttgtgcttgccattgtgcattgtgctgtgataaacatacaagtgcatgtgtctttttggcaaaacaatttatcttcttttggataaacacccagtagtaggattgctgagtcaaatggtagttctgttctaagttctttgagaaatctccaaactgctttggacaggggctgaactgatttacattcgcaccaacagtgtataagagttcccttttctctgtaacctgggcagcatctgtcattttttgactttttaataatagctattctgactggtgtgagatggtatctcattgtggttttgatttgcatttctctgaggattagtgacgtggagcatttcttcatatgtttgttgaccgcacgtatgtgttcttttgcaaagtgtctgttcatgtctttgaccattttgtaatggggtagttgtttgcttgttgagttgttaaagttacttatagattctggatattagacctttgttggaagcataatttgtgaatatttctttccattctataggttgtctgtttattctgttgatagtttctttgccaatttttgtttttggtgcaattgcttttggggactttgtcataaattctttgccaaggtcaatgtgcagaatgctatttcctaggttttttccagctggattcttttctcgtcttctggcaagtcagtttagaagaggttgatttattcagaaagtatccattttctttttctagacttcagacaggaaaatgtaaaatgagcaaaattctcgtgtataaactagctcaaaggtttgtggaagatttaaatgctgcatgacaggtagcaggtagtcgataaatgccagttgtgaatattgcttttcagattaaataacaaggctgaaagtaaatgttttggacaggctagctattcttcatacatccaacctaaaggtaatcatcctggtttatttatttattcaaaaaatattgaaaaattcacactgtgagccgggtcctaactagccctgaggatagcagtgaacaagacagtgtggagtttccattctagtgggaagaccggcaatgaacaagccaatgaatgtctgatcacacaaccggtgtgattacagcttacagctctttcccatgggagagtcaacagcttaatgggatggagagtaactggagaaggccaccttagatgggctggttaggagggagatgatgtgtgatctgaagagtgataatgaaccagccaaggggagaggtgagggggagaaaccaacagctaatgcaaaggctgggacgatgggagagcctggctagctttggactggggaacagggtgagttgatggtgggaggtgagcagtgatcagtccccaaagccacaaaggttttgaagcctgaaagggacatgacgtacattttttaaatctcactctcctgttctgtgagcaacagaatagaggacccggaaactgtagtagggttctgtttctacactagtgctaatgtagaacctcctacatccagaaagatgatagcagagctgagccacattcttcctggcaactgatgttcccacacgtagaaacagctggcatcctcatacagagggaggcttgcaggcccaggatacatctcatcccccttgctaatctcagtacttgacacccctgacctcaccaggggcaccaaacccaactgcttcctgcagggattcagctgcacttgtcatcacagagccttgaaatccctggggatatcaactccttggaattccaggctgctcttccacttgcttctgacacattgacttttctgcccattcactcacccatctttaaccaaggcctgtatggccagacatgaggccactcactgcctacatgaagagggaaagacaaagtgtatccctgggagctcgctaccttgtgtgaaaattacaacatcagatagtaaatgccttggtgaagatacgcatcccaagggcaggaagctccccaccttgatcactgcaaactccccagtccctaacagaatactgggaagatagaaggtggtcaaagcgtatgtatggaatgaacactggaaatcagtacacagggctgggaatgtgtgattctgagcactcagtgatggaaataaccctccagctccttcacagaacagccagcagcatcacctgttttggtgatggtgcctccggatgatgatccgtgagcgcacactggactcgtgctcctgggtgagctctctccttgtgaaacccagatgcttctgtctcccagggaccctgcagccctcccggtaacctggcctccatcacgaatgcagtctctatagacggttgtctattaggatgccactggagagggaggtcccgtcatcacctaagctaagcacagctgcctctaagtacctccttgcttggcagccggccagaccacattcactgagcttcaagtcataatgcgaggctcagccatctatctcactgtggtccccgctgcagctggcttcatttattgacttcttgaaagtggcaatatccatgctcagcttggtctgagctggactcagagacccaggtgccagagcaaaggccatggtgtgtcggttaatcacccaataaaaataaactctgagaacaaatacagaggggtgattaactttcccattctggtcttctgacatcccagtttgctctcccagtgagcgtgtttctttgagataaaccaccctgggaaactgatcacctgtccagacaccaccatgccttggcgtaagtggacaaaagtggaacgtgacctgcaagcagcgcagcctgagacttaggcagagagccccctgccccaggttccatgctgctgagggccttatcagaaactctgaagcagagcaccagactattttattctgctttttgctcttgtaataaagtgttattagtgtttagtcaccagattaaaccccaaagccttacctcccctcctgtgaccatccatgtactccaaatcatgaaccaaaaaacagggaccaccaacagcccttaccaaaagaagactggaagcacaaaaaagcaacttaccatgaatcaatttaaagtgaagaccaaagtgtgactcaaaactgaaaaaatatatgtatttggttaagatgtaattgttaccgaagcaccaggggtttggtctgggtcctgctgttcactgcacagaaagccaatcactgagacaagacaaaagccagggaagaaggctttaatcgggtgctgctgcagccaaggaaatgggaggtcagtctcaaatccatctctgaaatgaggggttgatgcaccagagaggaaatgtaaccgtgtttgggaaaacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccttaaaacttaaagtataataataataataataataataataaaaacagggattaaagcggggcaaggaagagaagttggtcagtaggaagcaggtggtcctttaggcaatcctgatggatgaggggtctggctcctcattatccagaggcagtggtctggtaagtttcagctccttgattttatctgggagacctgatggttggcttcttgagaaaggaactcagataagacaattgtaactttctcaagttttaaagtctggaaggaacaatttctgtggttattcaaaaaaaaaaaaacataagcgtcagttctgtgggacaatttgatcactttattttggagaaaaaaatgatgaatagaagtttgtttataagtttaaccccaataataggctagtctcacagtgaacacagatgaaccaagaattgctttgcttttgacataatttttacaacatcccacggcagtacatgccaaacttcaccttgtgctcagcttatgccctgcatttataaagagattgtctttcctaaccattcgagggctttgtccatttcccaaaggacctctccccagtcctttgccagtcaaatcactctttcgaagcagttgtaaatccactgtcctttctcttcttcaatcattgattcccttctctccattgcgttttcacttgtcatggatttacttatgattcctttttttcttcttgtattgctttacttgtaattagcaaataataattgtatatatttatgaggcataatgtgatggtttggtctttgtatacatagaaactttgatcaacatctcccccttcttcagccctctccctgctgccatgaatttgactcttttagattccacagatacatgaaataataaagtatgtgtctttctgggcttggcttatttcacttagcgtaattcttatactctgagtatcctcgtagaaccctacatcttttgtgagattgacagtcatactttgtgctggactggtgcatctttgggatggttttgtcactgggcgataactcatgaggtctgctgaccaggtagataccaggagtaagcaggatatttggctgcaagagagaattataggcctggtcgggagttcattcaggatgttgtaaatggaatactggggtgatgagcagtccttgtgggtcttgttcatatttgtatatattcaggcctaggaatgcagggaaaaaagggataaaacacactgaatgaaaagagtgtgaacaaatggatgaagagcctcacaccaagtaaagcttacgttgctaccaactggtaccaaactccaagtcgtcctgttcttttccaagcgccatttctgctgcttagaaaaagccacccaatctggatacatggatgtagcaaatttaaccttagacctagattacctataggatcagacttgatcagtcattaataatgataatgaaaattaatcatgaaagctatcttgtggttgcaccttaaagcatctgtgtaatgcttttacccatactaagagtgttcaatccctgttttcacctaggattgataagtgtatttctggatttcagaaatcggatagcttctgaagtctcagcctgttaatatggtaactaaatatgttaaggtcctagtctctcaatgtttaattactgtttaattttttatttcctaatttactcaatgtgtatgatattgttaaatttgtggctttataccctgaatctctttgtctgtatttctctgtattgcttggcagtcaatttggtcaaaagcaacaacgaaatgacccttacgaagtgtcaaatgtccctttatatgagatataaatgtctttgcaaagacacttataaagttgtgaagacgttgtttccttactctaatagctgctgtattcacgtaggtttcaaaaatggggtgggggagggcagtggcagtgagcgcctagcggaaactatgtcaatcacccctggaaataaatctgcaaaatggactagcaagccctgactaggaagagcccggccacagcaaaatcttattgcaggcacaaaaaggtcctattgcagcagttgggagacctttggtaaattctaacaaagaattaatggcctcgaacaagacgcccggtatgacctttgccagaagaaactaggagcagacttgcttgcctggaacaggtggtgaggaggttttcagagaagatgtgtgcagtccctggcaagtagctggtgcccaggaaatgtcagttccattgtttgccagggaaggctcggtgcacgtggggctcacacacaaaggaagaggttagagagtccgcagaaaagggtgggagctcaaaacagtggttcttaggcgtttgtctgcaggcacgctggtaattcatgctgaccatgcccacaatcagtggcacctagctgtggccccacccctttcctgcccactattgaaagtgactacatggcaaagagcgcctatttcctagactaaatcattctcagacttaagttattagtgagcgctgttagactcaagttccttgatatctacatcacaactgagtagtttatctcagtggtaagtctcgaagtttgacttcgaagttactaagagccttccaataaaagaacagtttaagccaatattgtttcaccattgatagtgatgaagatattaaattcacacacatgtgctgtgtgattttaaacctttctcaaatgtgtatgatttttataagcagaaatataattttaagaaagctttatatctatgtaatagggttcttttttttttgggaaatattgccatcctgtaaattccagtcctatgttcctgagttattccccactaaggaaagcccagctgtgggacatagacctggtttccacctcagagtttaaatcattattctcagaatggtggttctcaaactttggtgaatcagagccacctggaaaacatgttaaaaatggaaaggtcccatcatatcatcaacagccctgatcattctgatacacacccaaattggagaaccagtggcacaaacaaatgcccaaccctcgtgggctattcacaaggcaaacaaaaatcaagctatgcttgggaggcagagatccacattggaaccacacttctgctgctggaaagctgcatgactcaggcaagctcctagaccactctgagtctttgttttctcatgtgtaaaataaggtggtaatatctacctcccaggttgatgaggcaatggcagacagtaatgtatatgaatacatacatcgtacgccacctcctcagtgatcaatgaatgtgcgcttccagttgtagacacaacagcagaaagttaatgctgaaaaataggaaaacactcacaatgcatgatttacgatgtgagggagcctgctggcatggcccttgtcacgagagtaattaaataaccatttgtgtaattactaatttatatcctgtctccctgctggagtgtaagttccaaaaactggagggaatacactgctgtcttcccaacaccaagcgcggtgcctggcatgaaacagacacccagcaaatgtttattccaaatgagcgagtgaacagtacgtcacattaaaaacgtgtgtgtttatgtatacatcgatacataggctggaagcctctaggcaaaaatgttaatagtgcttatctctggaagtggattagggtgattttaatttttttcttttttctcctccgtattgtctgaattttctgcaattaacacagaggaccaaactagcatttccttgggtaaatgcgagtggagttggagccaccccctaccactgtgcctacaagagcatgttttcttgtgattccagcttccttgggggtttcaatatgtagtctctagaattaaaagggttttgggccaggtgtggtggctcaagcctgtaatcccagcactttgggaggccaaggcaggtggatcacaaggtcaggagtctgagaccagcctggccaacatagtgaaaccccatcactactaaacatacaaaaattagccgggcatggttgcacatgcctgtaatctcagctacttgggagcctaaggcaggagaatcgcttgaacccaggaggcggaggttgcggtgagcccagattgcaccactgcactccagccttggcaacaaagggagactccgtctgaaaacaaaaagggggggtttaggagaaataggaatttagtgatttctaaagataagtagaatttgttcttattcaccatttccttgtcctgatcatggactatgcaaaaaagagctcacacaacaggcctgagactgctgttcctagaaagacctgcctacaaggttggcctcagctggtatgtagaatcttggatgtggggagggctcccactctcttagctgataagagtgactcactgcacctaaactgcttgcgcgaacaaatgtggtttatgctgaatatctgttttccccctgggagtcaagaattttgctaatgccatgtggagggtgtctacgtgaccagccccccaaaaaaaaccctgaatgttgagtcttcggtgagcttccctgatggagaacatttcacatatgttgtcacaacttgctcctggaattaagcacgtccggtgtgaccccactgggagcagactcctgcaagctggtacctggtttccccaggatgttgccccatgtgccttttttctgtgctgttttccctgcgtattttccctgtgataagttttaaccattgaatatgacaatatgctgtgttctgtgggccttcctggcaaatcactgaacctgggagtggtcttcgggacccccagcacacaaacccacctaactaagccccctttgacagcatgtatcagatccaaggcaactaaagggatgggaatgtctggagcagcatagaagtgggagtttggctgggacaagagagacaggtggctcttttgagagacctgcctatgggggagggatgaatgagcactttagaattctgggtcacccagcacatgggtcaaccaatgcatgttaaagaaggtttctactctcattcattccctcatgcatgcattcaacaactgagtacctacccactcagtgtgtgcgggccactcttctagattctatgtatgaagggttaagtaagatagatgaggtcactgccccttggagctcacattctaagttgtagagctggccagggaaggaggcagacttcagagagaccatccagagtggcttctctagggaacacagaggccttggtgttggagctgagatcctacaaagcacaagacacacatgagaaaatctaagacttatccgatgaggcaagtagaaatgtgttgagaccagaaataatttactaatttcaaggaatgaaaggaaggccagcgagtctgtaacttagggaggctgaggaaagaggtagaaaatgcaggtagaaagtcaggcaggtccagatggatcctctaggaccttagagaccatggttaagagtttggattttattctataccccatgggaagtcattggtgggttttaagccggggattcacactctgtgatttaacactggctgctctttggagaatggactgtagcaagcagaagagaagcaaagaatcaggtgcattgcagtggtctacacaaaagacgatccctagtcgtcttaccacctgcctcctacaataaccaaagaaagtggacccacaccacagctacctcggtccactgcatgtgtggaaggtgatgattctcttgggcatgatatatattacttgttgtcatggtagggatcagaatgtctgtaaaaagcaaagttttggtccatgtgccatcagaagatgccagctgccatatgccagtcagaattgtcatgtgctagagcctcatgcagatgtccacaggatttcaccaggagctctgggatgcctgggaaggggatccagggaagggactggagatgtcaagagctcctgccctgttctcagctgttatggagtcacagaaggtcatacctacatgaaaggcaaggcaagaagtatcccatcctcccaaccccaagaggccctgcccaggccactcactggacaactcttcttgtccacatctgctggttgtggcaccccatccctgggaaatttgctaatttcaaggaattaaagaaaggccagtgagtctgtaacttcggaaggctgaggaaagagatagaaaatgcaggtagaaagtcaggcaggtccagatggatcctctagggccctagagaccatggcagtcctttctgtttactgagactgctttctttggctctggtttcctgggacaggaagagaacagtaccctggactgtgatgggctgtgactgtctaactaatctaggattctggaattcactagccattcaattttatccatacattttgtcagaagatttgaaatatgccctttactttacactcagggccatagctacatgagctattttaagatagtgtatttccttcaattgggagttctgtctctttctggttctgcttttaataataaatacggggtccagtggactgaaattaaatagggtgtgaagaattcccctactgtttcccttctttcctacagttttacagggttgtttgtatccttcagcaggaatataaaaataccctgtatctcctctcctttcgtagtttttattttctacgtttctcatagtctttcctatcctactatatatatgtgtgtgtgtatatatatatatgtgtgtgtgtgtgtatatatatgtgtgtatatatatgccatatatagagatagatccatcttccatctattactatatctataatctccctatatataaatttgatacgtatataatctgtgccatgtctagtgctctgctatattgcattgatccatttggctattgtgcactaattgcccaatattactttatgacatttttaagtctaaactgaaaggaaagctatgctcagtcatgtaatgttggcaaccatgctgcgcaaacatgggtcccctacatcaggggtccccaacccctgggccacggacggccccaacccctgggccacaacatcagattgttattggagcacaaatcctattgtgaactgcacacacaagggatctaggcggcacactccttatgagaatctaatgcctgaactgaggaggaacagtttcatctccaagccatcccccacctgttcatggaaaaattgtcttccacgaaaccagtccatggtgccaaagaggttggggactgctgccctacctcacagaaagcgagtgaccccaagaagcctgcagaagggacttgtcaaacctttgatctctttcaccttcccaccaatacttgagcccctgagggcagaggctggcagcccttggctctggaagtccttccaggtcaacagctggccctggccacttgcctggaagctttcttccctgctctgagggggccctgctgagagtgagcccgccttccagggtggcgcaggccccagtaacccccactgcgctgcctgcgactcgaattctgttaatcagtttgccttgcgtctcccaacaccgacacccagaagaggccgaggcttggcaagcactcagagcagcttctgtgaagctacattacaggctgaaatgagctcagcttttaatttgattttttttttcctgtaacaagcaaagttcacattacagataaattgcccggaaattccaatttaataaggcgtatgcatttttcaggcctagaagcattgaaaacatcttgcacgctagtatttttacactgaaaggtttattaaaaagacagctttgaaaatgtcagaaatttacatagcgcgcctggccgattggtcaaaaagcctgattggacaaaagcgcacggaagccaggaagcgggagagcaggctgttccgtggtcttgagctgttctccctccacatcgggaacgatggctccaccgttcattgtctccacccagctcttagttcatgttacatgggtgctcagcaaatgagtgtccgtctgtcctcctctgtctgcaggtgtgtttctgagtaggagcagcaagctgtccttccagggcatctgtggggcaggcatacctccttgaggtctcccatgggaggaggcaccaaacaaaataagcaaactggccaggtgcggtggctcatgcctgtaatcccagcactttgggaggccaaagcaggtggatcgcttgaggtcaggagttcgagaccagcctggccaacttggtgaaaccccgctctactaaaaatagaaaatttagccaggcatggtggcaggtgcctataattccagatatttgggaggctgaggcaggagaattatttgaacccaggaggcagaggttgcagtgggctgagatcgctgccactgcactccagcctgggcgacagagcaagactccgtctcaaaaaataaaataaaataagcaaacagaggggagcagaaagagtcctgtgaaaactcagttaaatagcacagctctggatacttgattatttttttaaggaggaaaaagagtgagacattgtcctgtaaaatcacccaaaccctggctttccctggaaatgtggcgcaggcaggcctaaccgtgctgagtattgtttctgaggactgcctccgagttcatgtctctaagcattttattgaatacaactgcttctttgacaagaaacaagcaaacatgctaattgtacaacaaaattatggcatcatgggacaaaaaaggaatgacagagggagcatcaaagagcattgcttgtacgccaaacatgaaagccaaatttatttaattcagtttttatttatcttctaaactgagttgagtaatcaggcaatagaatgcggttcatttaaaactttcattatttcaaatatgttgaaccactaccaatcactcctggatcaacaggaaacttgctacctgatgagttgccttttttcttttttctttttttttttttttttttctttgctttttccatccccatgattgttccaacagaaggagaaaagatgtaataaacctttaccgggcaccgtctgcgtccaggcactctactcggccctgggggtgcagagcacaccaccccagccttaggcatgaaaaacactgtgtaccgagaagcccagcccctggaatccagcatgctggtgctacattccagctctgtctcttattaactgggccgcttttgacaagttgctaagcctctctgattcttggttacctcaaccttaaaacaaggatgatacccacttcatcaggttgtcatgagtcacaaaaataaatgtagtgatgctcttaaagggtttagcaccaagctgggcccaaggaagcattctgtgtgtctattgaccaacttttacctatcctgacaccaaggagcttagagtttagtggagatggcagagccgtcagggcccgtgttaggctcccaaaggcatttttaccagtgcatgtgcctcgcacagacctagtgaggtgattaattctactgggaaagtcacactggatgaacgagaggagacgtatgagtggggtcttgaaacagtaaaaatttgccaggtggaagcataaatgactctttaaatgaaagcctggtgtttttaaagcagttcattctcatgagtaattcatcgcttctgttttcacaaaatagtgaaaggatcattgcagcagcaagggcatgtggaagccctgcgttcgcctcatccgttctccccatctgtcccctgtcacagttgcagcatcaaaacattgttcccctaggctctgctgagtcggatgtttctgaaacattccaggggaccgtgtgagtcacatcagggaggacacacagggccatgaccccagtgagccattaacacacccatagcctgactctgcaacggctcccccgagggcgccccgcacaagaccaagccctttgtgtcagcttcagtttgccctcacagctaccccagaacaccactgggactgtccccgagtcacagaggaggaagtagaaacacagagaagtagcttgccaggctcactgttagaacccaggtcctttcctctccagagtccatgactctaacactcatgtgatgctggcaatgtgaacggctggggggaagcagcagagggtgacagcaggccttggcaccagagatccagcctgcgaatcccaaccatgccccatattagccaatgatcttggcaaagttcacatatctctaggcctctcagttcctcatctgtaaaaggggaggaataatattatcaacctcccagggctggtgtgagggctgaaggcatagatgctggaagctcctggagcggtgtccagccggcgcaatgtaaggctcgatgctgctgcagctgtgttactattaatattaaagggaggctgcaccccgaggctgttttaggaaagaacaggccagacgccttccaggaagcatcagcaggagcctctcctggcgtccttctgcagtttgggggtctggtacatccactttgcaggacaaaaacttgatttgattctcaggtcagttcacatgaccccaacacaaaaaggattgataccaacccagaccgcctctgtgtgaattaaatttacaacagcgctgtatcagagcatctgtcaatgctgactggaagcccaaagacctccagatgattggttctgagactccaggagaggctgggaacactcggaggggctctggatggtggccaggcgagggtggtaggtgaattgctgtctgtcctgggtcgccatgaggcttgtggtgactgcatagatgcccattccctttgtcagccagcaatttcttattccctggctccccttctcaacaacccaagttgaccatcccttcttcagtgaccacagcctcccccaggtaacaatcccattgcagcccccaagatgacctttaagtcatggacaagggcagttcttcttctccttggccacacaggaggcatccctctggcttccacctacatctgaataatcccacccaccacacttcgattcaacttaactctatcctcagaggccaccttttctcagaattcgtatcttcttcgaagtaagatccttcaggtgaaacatacctgctgaccacccaccctgagtcactaagttagctgggaagcagcagttttgagtgtgggttcagggtcgcagctccaaggtcagaccacctgggcccacgtcctgactctacgatttgcgtagctgttggtttgtgcctcagagtcctcatctgtaagtggggatattatacctactataataaattagtaatgccacggtaacaaagtattgcaaacatggaggctagaaatttattctcccacagttctggaggacagaagtccaaaatcagtctaactgagtcaaaaccaagacgttggcagggccacgttccatctagaggtctaggggagggtccttcctgccactccccacttctggtggctgcagcattccttggtttgtggccacatcactccaatctctgcctccacggtcgtgtggtcttctccttttctgtgtctcaaatctcctctgcctccccctgaggacacttctgattgcatttagcaaaccacaaacaaccccaagataactcaaaataatctcatctcaaagaccttaactcagctctgcaaagtctttgctctatgaagtaacattcccaagttccaggattaggaggtagatatctttttcccgtgaagactcggggttaacttgctccaagcccttcagttggagattttcaatcctgttggttaaatcaggttttaaacatccttagacccaaatctggccatacaaggcagagaaaatcaacttcatgcatctttaccagtgtaaagattcccatgtcacttcatggggatgtacttcaaagatgggtaggaaatggcagcaaagtgccaacagcatctttctggcttaggtctgcaagtggcacattatccaagccacccaattcaaagaaagctgagtcatgcccagttgagtctccctgatagataagactattatttcttactctatgcatctatattgtttaaatctcaaaagagcaacctcaaaacaagtaacattttaaaatcttggatggtttcccattatccaaagtcaaaaccccttaaaacagtagttcaggttctctataatattgtctaatctgtttctcaaaactcattaacttttagttcccttaaagaaactgtttcaaacacaaccctctactttctagtccctaaatatctgtatattcaacaaatatttagtgtcgcatatgggctaagcagtgttcaagcagctggtgtcacagcagtgaacaaatttcttgccctcgcgtaacctacatcctaatgagtgtttctgttccatctgtaatagtttggctgtgtcctcacccaagtctcatcttgaattcccacatattatgggagggaccctgtgggaggtaatcgaatcataggggcgggtctttcccatgctgttctcgtgatagtgaataagtcccatgagatatgatggttttataaagggaaacccattttgcttggtttcactctctcgtctgccaccacgtaagacatgcctttcaccttccgccatgattgcgaggcctccttagccacatggaactgtgagtctattaaaactctttcttttgtaaatcactcagtcttgagtatgtctttatcaacagtgtgaagatggactaatacaatttgttaactcatattctctcttcctggtttgtctgtcctctcactctctgatgacatcctatctattcctcctgtcttggtttggatgctgcattctctgtgaggtgcccaatattgccctggatcagaggtagtgagttcttcctccaagcattgatgtgccctgcttgtaccttcacaacagcacttctcccactagtccacatacgagatacatctgaggtgtgaaagaaacaagactggacgtggactcaggatttgggctgtgaattctgctttgcttctgtgagagcttggcagatggcaagaacatcttcctcctgggagtgtcaagaggaataaaggaggcacacatgcaaagtgcttaacacaaagcagacccagagtcagtggcctcttgactttgtgaatgagcaactgtaacagaaatgatggttttggatttttgttacctaggatccagcacctagcctaggagctcatgccctgcactctgtaaatgtttcttgaatctactttgaatgcagagtctgacattgtggggatttttttcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggtgagtacttgacaaagaccatcaagggtatacttttctgctacaaatatacttttacatttttaaatttcttctgatacacccaggggtgttcttgggaagaatgtaagtgtgtgggaacagcaaagtaaatgtttaaatatacacatgttgagttcagtaatatctccaagtcccagaatcctcagatctttttggaaagtgaataatgtctggtgagaggtcagagcaatgaactcaccctgtcccatcttgggcaggcgtggaggttagaaagccacgctgatgtgctttgtcttggtgtcatgctctcatttgcaaagaggctcttggacttaatacaagttgaaagtaagtcccagaggacatcactgaccctgaccattgaattgttcttgtagcttttatcctattatgacacgctgccaaggaaaggcatcaggtaccctcagttagtggctgcacaaccacaaagcaattgctgttcgttcaaaagatggtaatgcactatccatatgccagcccctgattagatgctgggggcgcagcagtaaacaaaaagaaagctgtcctcatggagctgacgtgcagaaaggaggcaaagttcaaagtgccacgattgttctctgctcctttgagatcagactgtagggcacaagggcagaaggagggcaacctcttaggagagtgcatggtaatctatgcaagatggtggcctggaccagagactaggaggggatgagaaaaagagagttcctatatactttgaatgcagagctgacaggatttgccgttaactgagatgaggggattccagttggtttggggacatgttaagctgcaatgtgtattgtgtcaatcacacaagaagttttgttctccctattattcctaaaagccagctgtttatggctaaagattcagttttgagtccttccatatcaagatgaatatttataggtgcccattgttatactcaacaagggtgaactaagagttctcagtcctggtcctcgtatgccggctactcacacaaaccattaggagacaagtctaagaagtgagcaatccatgtgacacacaataagtagagagtgcttcaaaataaaggtgagccttggggttagccttgaaagacgggtaggattcggatgagtggcattacccagaaatccaaggcagaggaatcaaaactagaagggggcacagcacaggaggtaagaaaaggaaaaaataactgttgtgtctgctataagtgcgtatgtaggaatctatttggatgtatgtggaaaagtcacatcttcaaagccagatgattcatttgatagaacagggaaccaggagaccctgaaacttcttgaggaggaaactgacacgatgaaatatcaggtagacaatgttcagcaactgagagctggaccagatcttgtgcttggtcctggagactcatggatgaataatacatggtccttgtgttcagagggctcatgaattatttggaaggttagtcaagtacacagaagatcacagtagagtgtcctaactgttctgatggagctaagcccagagaagcccctgtccagcctggggggtagtcatggagagctgcctgagagaggggacatctcacctgcgtgatgaaggatatgtggattaaaggtagggcatgctagttctggtgttgagttagttggcagcttctgattggttagccttaagtttcgtttttctttaacatagtcatttataagaaatagctcatgttggctgggcacggtggctcatgcctgtagtcccagaacgttgggaggctgaggtgggtggattacaaggccaggagtttgagaccagcctggccaatatggtgaaaccccatctctactaaagatacaaaaatgagctgggcatggtggcacacacatgtagtcccaggtactcaggaggctgaggcaggagaatctcttgaacctaggaggcagaggttgcagtgagccgagattatgccactgcactccagccggggtgacagagtgagactccatctcaaaaaaaaagaaagaaatagctcacgttcagttttgcttatgtttgcaaatcaagcaaggttaaggtgacttatgacacctaactggctttttctgcccagtggttcttcaggcctaatttccattttaatttactttaacaattgatatgactgaactgtgtcctctcaatgttgacgtattggagtcctaatccctggttccatagcatgtaccttatttggaagcaggcttgttgcggatgtggttagttaaggtgaggtcatgctggagtaaggtgggccctgatccaatatgattgatgtcttcctcaaagggggaatttgaagacaggcatgcacacagggagaacaccacataaaatgaaggcagagatcagggtgatgcttctgcaagtcaaggagttccaaagattccctgtaaacttccagcagctgggggagaggctgggaggagagccttcctcacatccctcagcaggaaccaaacctgcagatgcttcagtcttggacttcaggcctccagaactgtaagacaatagatttctgtcgtgtaagccactcctttgtggcactttgttatggcaactctagcaaagtaatgcaagatttaatggagtcattacctataaagcatttggaacagtaccttgcttgtagcaagtgcttaacttaactatttaaaaaaaaaaaaaaacaggtaaagcattctagtagaataaagatgtgagaagttgggaagttggtcagcattagtggaagctagcatggcaggttctttgtgtgcaaagataagggcagagaagcgtgtggataccggactgttctaaggttggaactgggtcttgtgctgaatgcccagcacctaccatggtgcctgacttagagcaggcactcacatgcctgtagaataagtcatgaaatcaatcgtgaaatgctccacatgctatgccatggactttggccttgaaaatgtcactcacttgcctccagaataaacattgtgttttacaaagatacacaggcacagtggctcatgcctgcaatgtcagcactttgggaggctgaggtgggcagatcgcttgaggtcaggagttcaagaccagcctggccaacatggcaaaaccccatctctactaaaaaaaaaatatacctcccctccacaaaaaagaaagatacatcctatagcagcatagaaaatggacgcggtgatggcaagatgtgaggagggaggcattaggcagctgccgcagaaatacaggtaagagaaaagagaggaccaagccaaggtagtgaagttagttggggaaaagtcagcctgcagtgggtaaatgtgttagaaaccatagcaggtatcttagttgatggggtcagagtctgcgcaagcataacataaacggaccagaggggaagaacctagataacatctgaaaggaagaaacaaatctttgtcaagagcttatactgaacatgagctagagaaatgcaatattcaggtttctggtccagaaatcaggaatgactatttcatcaacgtaaacagggagtgagtttcagaggactggtccttcttgttttcggagggtgggtgttgagattacgtcccagaagaagctggcaagatagaaatggaataaggagagattttgattagggagttgcccatgcagaagagatgcgacttatcagaacagaaaagctttccaaaaggaagaggtctggacagagtactgagtacagaatcagggatgaaaataagccaagattgtttaaaattctgtgtaaaatgaaaagtatccattactgatcagctaaagtaacaatggcagggttctgtagtatgtagaagtatctgtatctgtggagaaatttctcagcaaagaatgtcaagaagcatggatgaaatatagcgtagcatggctggcatttctttgtgaaattttttgtgcaattataaatccaaagaaactagaaatgcggtatacttgaattgttaccagaagcgagagccttctttacatgtatgcagtaatcagttaagtgacactgtgtgcgtatataccgtgtcccgaatattaagaagaacaaaaccaaaatttgcagattaagaaacagacaccaaatttagttggctttctaaaagtcgtatcattaggatagcatttttctacctttagtttcttgcatttttaacagtctttaaaatttctgtgtggaagcagcaatctggtctaaacttccgccataccacttactagctatctgattttgaagaaataatttacaatgtagtcaggacctaatgataccttacagctgtttctcatctttgagactcattgagtctcatctatgttttctcaacattcagcatacacctgtatgaactgtctggctgtgtaactgtgaaagcttctcacagactgtgagtctcattttctacatatacaaaatgaagaagataattcctacttataacgttgtgagaaatgagtgaagtgctgtaccctctagattctccatcaaaagccatattaaatgttcactacatgttaatcccacccaggtgggggtttcagaaaggaaagaatagagccaggaatgatccttccatgacccaagaaatatacagcttgaaatccacttgttgtctaactctgttaacgctaatatcagacacggaaatttaaaatctggtaccacagatgtttccagagagctaaaatgtccccaaaggtgtaatggtaaatagaaaccaggttggcattaacatacaaaaccatcgttaggaataataatctcgaacaagacccaaaggacttacagcaaaaagaacataaattaaaaagcccttataaatcagagcaacttttatttaaaagctcctttttgcctcaccaaaaacttacctctagtattatgtttaacccggaaaagccaacactatctattagatcaaagttagtaggccaagcaaggtggcttacacctgtaatcctagcactttgggaggctgaggttggcagattgcctgaacctaggagttcaaaaccatcctgggcaacatggcaaaactccatcccgaaaaagaatacaaaaattagtcatgcacagtggcacatgacttgtagtcccagctactcaggaggctgaggaaggaggatcacctgaacccaggtaggtcaaggctgcagtgagccaagatcacaccgctgcactctagcctgggcagcagaatgagaccccgtctcaaaaaaaaagtaaatagtgctaactgatctctcaactttatccaaagtgagcatttgtttttattagttttatagaaatttaatttatttgatggaaggagagaataaggatttttggcatataacactaggaaagctgaaccaaaataaattgatttctccaaacaaagagtaactcaggaatttatgccaaaacatgttgataaaatatatggcttcgggaacttccatgtaggatacagtacggaagtgtccccactgtgaaactagaaaaatctagttaaattataaaaatcagataatataaaaaaatcttaattgtaaaggaatcagggagctgcagaagcattgacaactagataaactaaaataccaaagagggaaaagtcatttcaaaaagaaaacctttttttttctctgggtgcattttctgattctaggtgagagtcaggcttggcccatgcagagagcctaggatggagggaaagaaattagaaacgagtgtcagaatcacagggagcttttgtgacaaactggaaacttgaggggctgcttttcctctgtggacaaatgccctaaaggacagagtgaaatctccttgggtctcacagaaaacagagacctaccaaaggaagcaagctctcctcaaatacatagccattctctcatttaagatatttgccagattttgaaggtacaaggagttaaaggatggggtgtgggatggctggagagttaagatggtaaccactgaagggaagaattggatttcctggagcctttcagactaagatactccagactttcaatcaaaatcccagtagggccatgcccagcaacaggagtaagccagaagttgactcagtcttgttcaacttgcaatgcggcctgacccttttcaagcccttactaagttgatgaagcaaggctccatctgatacagtttggctctgtgtccccacccaaatctcatcttgaattgtactcccataattcccatgtgctgtgggagggacccagtgggagataattgaatcatgggggcagtttcccccatactgttctcatggtagtgaataagtctcatgagatctgatggttttatcaggggtttccacttttgcgtcttcctcattctctctttgcctgctgccatccctgtaagatgggacttgctcctccttgccttccaccatgattgtgaggtttccccagccatgtgaaactgtacattcaattaaacctctttcttttttaaattgcccagtctctggtatgtctttatcagcagcatgaaaatggactaatacatcatcctatctgactaatacaggagagggaaaaactcatagcaccatatgtcatctggagcctctccaatcttttttttaataatgcccaatttacagttttataaaaattacttgacctgtaaagaagcaagaatgtgtaagtgatgaacaagagaaaaatcagactacagaggatccagatatttgaattagcacacaagaacattaaaataaacatgattagtatgttcaaggagacagaataaaagatagattcaagcagagagaattacacaagagatctgaaatctttaagaaggaatcagatagatattccagaactgaaatacatattatcatattaaaaactcagtaagtagacttaacagcagaacacaggatttttaacctggaatatgaatctatagcaaacaccacaagggaagcacagtgaggataaagaacgggaaaaaatctgccaaaagactagtgtgtggaattggagttacagaaggataggagagtgctaatggagcagaaaaaaaaatttgaagatgtaatgtccaggaattttccaaaactgatgaaagacattctccctattaaatcaaaaagtttagcaaaccacaagctggataaatttgaagaaaaacacacctcaaacactgaaatcaaactgatgaaaaacaatatcaaagagaaaatgttaaaaatagcctgagaataaaagaggcatttacctgcaaatgagctacaatatgacttatggctgacttctagatagaaataatggaatgtggaaggcaatggaataacatttctctgagcactttaaagatgcctaccaacctagaattctttagttctcaaatttttcccttcaaaatcaaggtgaattaaagacttttggggcaaaaaaaaaaaaaatggaattgtattgcaagcaggtttatgccttttactgaagagaatatttcaggcagagggaaaatgatgccagagaggcatagaaacacaagaaacataaataaaaatagaaagttaaatatgtataaagtaaaaaagtaaatgaagtaaaattgtaaggacataaggagttaaaaatatttatagaactaaaatgcatgacagcagtaacagaaaaagtgagaggctataaacatagttaaaacagtttctgcagcattggagatgtagttaaagcaatactttgtattagactctaataagtcaagtatctatattgtataacccttagggtaatcactaaaagaatataaaagaaagtaaaactaacaaattaatagaaggaaataggtttgactaatccaaaataagaaaggagggggaacaacattaaaaagatggccaaatagaacaacaaggtgatacagtaagtatatacctaattataccacagtaaaatgcaaaatgtaaacagattaaatatttcaagtaatattatcagactatttttaaaaatcagcaaactggatgctacatacaatagacacactttaaataaaagaacaaagaatggaaataaaagaaaaatataccttgatagtacagtctctcctaaaaacacatgaaagtattttttaaaacaagcttgtccaacccacagcctgtgggccatatgtggcccagaatggctttgaatgcggcccaacacaaatttttaaactttctttaaacaacattatgaaattttttggcgctttttttatagctcttcagctactgttagtgttagtgtattgtatgtgtggcccaagacaattcttcttccaatgtggcccagggaagccaaaagattggacacccctgtttaaaacaagaaacatgacaagaggtaaagaggccatttcataatgatgaagggaggtatcaaaaagaaggacatcacagtcctaaatctgtatgtactggacagcacagattccaaatatacagagcagagaaaactaaaaagagaagtagacaaatctacaatcattgtgggagtcttaaaacatctctcatatcagcttcaagaaaaaacaacaaggagtaaagctgtaaaagatttgaacaaaataattaacaaatttcatcaactaacatatatagaactctgaactcaacaactgagttcattcttttcaaattcccaaggaaaattacctaaattgtttgcatgcagagcatatagaaaagtctaacaaacgtttttaactgcaattatttctagtatatcctccaatcacaatggaattaaactaagcattagtagcaaaatataaccagaaacaccctaactgactgaacataaaacagtacacttccaaataactcataatcaaaaacaaaaatagaaatatgaaatgtcaaaacttgtgggatgcactaaaccagtgctcagaggaaaattctagaaaataggaaacaaatatacaagacaaaatcaacaaatccaggctgggcacggtggctcactcctgtaatcccagaattttgggaggctgaggcgggtgaatcacctgaggtcaggagatcgagaccagcctggccaacatggcaaaaccctgtctctaccaaacgtacaaagattagctggatacagtggcatgtgcctgtaatctcagttacttgggagcctgaggcaggacaatcgcttgaacccaggaggcggaggttgcagtgaaccaagatcgcaccactgcatcccagcctgggtgacagagcgagactctgtctctaaaaaatttttaaaaattgaaaatcaacaaatccaaaagtttgtcctataaaaagattgaataaaattgtaaactcatatcgaaactgttgggcaaaaaaagaaaaaaacacaaattaccaacactgggaataaaaaagggaaaatgactatagccatcaaaaagatacaaagatattatgaacggcattatgcaatatatttgacaatttggacataatggacaagtttccccaaaattaaaacttatcaaaaataacctaaaaagaggctgggcatggtagctaatgcctgtaatcccagcactttggaggccgaggcaggaagatcacttgaggccaggaatttgagaccagcctggccaacatgacaaagccccttctctgctaaaaaatacaaaaattagctgggtatggtggtgcacgcctgtaatcccagctgcactctgtcccaaaaaaaaagaaagaaaaagaaaagaagaaaatcttaactagcccagtgcttatggaaaaaaaaaaaatgttcttgaaaaccaaaaagaaaactacagatccagatggctttgctacatgtttccaaatatttaagaaagaaaaacaattttatacaaacccttccagaaacagaaatagaagaaatacttaatccctctttttatgagacaaggtttttccaaaacctgacaagatcttacaagaaattaaaattgcagaccgatctcactcatgagcataaatttttaaattcttaacaaaaatattaatgaatcccacaaaaatgatatgatcatctcaagagttgcatttgaaaaaaattcatgttgatttctgatttttttaaaataatgtttagcaaactaggaaacttttttagtctagttttaaaaaaaaaataacagaaggagctgctgctacagcaaacatcttcctcaatggtgaaatagtaaaaactttttttgtgacctcagtcccagccagagcgagaaggcaaacaaaagaaatactaggcttaggaattaaaagtaagaaatctctttattcataaatgatatgcctaaaataatctaaaagaattttcagagaatctattactgattttagtaaaggtcatcaggtataagatcagtatacacaattaattgttttatataccccagcagtaagcaaatggaaaataaaattctaaaagatactgtttgcaatatcatcagaaacaccaaatagcaaggtataaatttaaagaaagatatgcaagtcctctacaatgaaaactacaaatgactgcctaagataatttttgtctccctatttaagcccacattaacggagagatataccatgttcatggattggaaggctcaatggtattgaaatgacaattcttttcaaaccgacctgagggattcaatgcaataccatgcaaagtcccaatcccagcatggggatcggggcagaaattgatacactgattataaaatttatatggaaatacaaggagtgaaaaatggccaaggcaatcttgaagaataagttgtagaacttacactaccgtacatatatccagacgtattagaaaaccatagtaattgaaaccatggtatttgcacaaagatgggaacaagctgaccaatgcaatagaatagagaattcaggaagaattccacacatacccagtttctgattctaacaaggaaaacacaacacagcagtgcaggtgagaaagcatggtctttcaataaataaggccaagttgattgaataaacatattttttaaaatgcatcctgaccccctcttaaaccatatacaataattaattctagatatattacagatcaaaatatagaaggaaaaaatgcatattttagagaaaaacatatgagaacatatatgtcctttgtgtaagcaaagcttttcgtaattaggatacaaaagtactaaccacaaaagaaaaaaaaaagatagattacattgaaattaagagctttgattcttcaaatgacacagttaagaaagtaaaaagtaacctacagagtagaagatatttataatacaaagaaatgctgcaggcctggtacagtggctcatgccctataatcccagcaccttgggaagccaaggtgggcagatcacttgagccaaggagtttgagaccagtgtgagtaataaagcaagaccttatctttacaaaaaataaaaaaaattatccaagtggtgtggcacacacctgtggtcccagctacacaggaggctgaggcaggacgatcacttgagcccaggagttcaaggctgcagtgagccatgatcacaccactgcactccagcatggaggacagagtgagatcctgtctcaaaaccaataaaaaaaaaaaaaaaaagaaagaaatcctataatctgtaagcaaaagacacaacccaaagaagaatagataagagacttaaacaaatacttcacagcagaaaatacacaaatcctaacaaatgtatgaaaagatgctcaacttaattaaataaagatatatacattaaattatacaaatataaattaaaacacaaattaatcaaggaaatacaatgaagtgcagtacagcagcatacctataaaatggctgaaatgaaaagatgaaaaatacccagtgctggcaatggtgtgaaataattggaactctcctacacagctggtagaagtgtaaattgggtacagccacgttggaaacatagtatcaactaaagctgaacatacatatgccctatgttccaggaattacatgcctaggtattatctatccaacagaaatgtgttccccaaaacacgagtgccagaatatccactattcataagagcccaaagttggaaattatccagatgcccagcaaaagttgaataataaattgtgatacattcacaaaatggcatctgtacaataataatgagtgaatgaactgcaactattcacaacatcatgggtgaatctcacaaacatagtgtgcagcaaaagaaggctgaaacaagaacacacatgctaaatgactgcatttatataaagctcaaacccaggcgaaattaatcctagccagcagatcaccttgtggatgggtttcttgatctggtagtactagactacatgggtgtgttcagattgtgaaaattcttcaaactgtgtgtttgatacatgaagatttctatgtttcaataagaacctaacaaaaaatgcatggctgcagagagagagcacgtagctagtcctgtaaccattcacatattctcaagtaccttctgagcatttagacagactctcagcatcttgttccaaggaagggcaatccctgtttgctgatgggccaattttgccaggaaaggtgagtgataagagttctacataaggaacaaagcaaagcaaatcatgttccctgcagtccctaccatgctttgcaacgggcagaagtgacaccatcgttaacttgctacacacagctcaacatactcagtttataacaattttaagatggtagcaaacgataactttcctttaaataccccttagaggatacaaactgtcagatcagaatggagtgatgtcaaaagagcaggactgaaaacctgatctgaggttaacagaaataaagagccctttggacctatttgcttggggccccagagctagtctagataatttctagaatcgtgcttcataataattttgataatgcctaggttgcagatgacttgaggaggaaaagacacgttgtaaccaacagaatattcaaggtactttctttaaacttaaaagaaaatccttggctagattacatttcactgagtttagttgagcaaagaacaattggtgaattgggcaacctctcaagccaaagtaagctgagagagactccagcgcaggcatgtagtggaagaagatttatggacagaaaaaggaaaatgatgtacagaaaatggaaatgaggcacaaaagcagctggattggttacactcggcatttgccttatttgaacgctatttgaacagttggccctttgattggctcaaactccgagactggcacgagagtaggtgacagtctgtttacacctccattcagattatagttcactatgtacagggaaacctttaggcggaacttagcatatttaagaaggcagctttaggctaacttgattttacaaactgttatcagtaattttaatgcactataaccagcaaagtggctcacgcttgtaatcccagcactttgggaggctgaggcaggtgggtcacttaaggtcagtagttcgataccagccaggccaacatggtgaaaccccttctctactaaaaatacaaaaattagccaggcgtggttgtgcatgcctgtagtcccagctactcaggaggctgaggcaggagaatcgcttgaccctgggaggcagaggttgcagtgagctaacgccactgcactccagcctgggtgacagagcgagaccccacctaaaaaataaaataaaaataaaataagtaattttaatgagctgtaaattacctaagaacattgtttcaataaaacagaaatgcttttgttttgctacatcaaaactggctgtggccaaatgacttgatgagtaaagcctttaatcctatagattaataagttgtgacctttaatgctggcattttatctttagagatgaatatcgtcatttgccttatatggtccagattttctgaaaggtcaaaatagtgccttcagagtacaggcactcttttatggaagacttcaatgaacacagaattgctgccctctcttaagaaaggataaaataaaaaaaactgttaaggaaaaacccaagcggtagagagaacattcgggaatgcaataaaatggaatccctttggggatgtgctggcagtggagcaaggcagtagcaattagcactggccaaatcccagtgtcaataccactcctgcctacaggtaatcaccagaaaggtcaaatgttagtcgccctgtcttatgtgggctgaaaactgtcacaggcgatttctcgtaagggttctggaatcccactggggacggccacaggcaggaaaggcatcgttggccgctgcttcttggctcactcactccacgctcactgctcagaattctctgagactggtcttcctgcctccttcttactggtaacctaatctttccccctcctcttgcttgaaaattgtgtagggttcattgttccatgattgttattgaatggggctcttatgctctcacagaagacctaaatgatgactgcaaacaatgaagacaaatattttgctccaggaagcccaaatgccctctcacactctgccaagtttaaagaaagacgaaaacaaaaggtgtccctgttagttccccctaaggctcagggcatatgaaatagtttgaacctggcagcccaaaccatctctacggggcccgtattaagtctttatatgattatcaaacgcgtcatattccccatctatttccatttaaaagaacgggggagtgatggcttttaaaacaagccaaattaccactaaattcagcagcatgttttcatgacttagcaacttatataaagtatgtttgagcctgccagtgaaaaatgtgatgtgggttgccaagaagacacacagatatagaaccaggcataacagctgtaaaattaaaatggaatagactaagataatgatttttcataggctaagatatatcatgtcccagcctgtcttctccttcagtcctctgtaagatagatgttccaataatgccagctgattcaaaattgaaatattgttcaaaatatgcttagattgattttttttaaaaattgttattcagccccagagtgaaatgactactgaactactgaatttatagcccccaaactgagggtgggaggggctctgaactgaacttcagaaagatacctcagcctgtggtctttctcttttcatagctcaaccaagctctagactgcaggggggatatagtaagattatttagattgattctacttaaaagatgctagtttggataaaatgaagccattagttatgatggcaacccaatcaagccagtttaacaccccttatctcagctgtgatattaattgaggaggaaaaataaattgatgacccagccatcattccgccttacttcaagcactcgcaaaatatcagtcatgttgaaaatactacctacagtttgtcactgacaaaatggcccaataaaagaactcttaagatctggtaatagtgaggtgtgatcagagccattggaggggcagcacactgggtccactgagataatggagcctagtgccatctacacctcaggatgagttcagctccgcatcttagctgtgcaatgatagccgagagacttacactctctcagcctcaatttccccacctgcagaatgaagataatgccatctgcctgctgggttgttagagggttggaaatcatgaatgcacaattcccagtactcctaagcatataagaaatgcttaagtgaactgacttgaactgagtcatggactgatcttctaagcatgtcattacagaatcatgagtgctgaggcaaactatgaaaaggcacttatgaccaccgtggtggtgatctgagcatttttctagggaatggatgggccatggacccccccacttggacaaggatgctaaatccaattagccagaaaaggtgtccttggacgttggcatcaattcatggagcttgtctctggctgaatgggcaggtggaagcctgacagcaggacatttctacattgatcaggcaaatcaactatcttaaacagaacattttcattcattttttatgcaaaagaaactgattttgacattaaaatactgtcagtgatgcccatctcaaccagttcatcctgccaaagtgtcttttagctggtcccccactggagtcccccttccccagctttatattggcattgccatctacccagtcctcaagcaagaccccttcctctgtgaggctcccaccccctcagcctgctcagcctcctgaagtcagccctttactcttgcatcctgcctgccttccctgaggcccttgccacggctgctcagcctcctgaagtcagccctttactcttgcatcctgcctgccttccctgaggcccttgccacggctgctcagcctcctgaagtcagccctttactcttgcatcctgcctgccttccctgaagccctcgcaatggcctccatgacagtcctggcctcctcactcaagtccattcctgcctgtgcgtctgcatcctctgctttgtatcaaagccattctcctgctttaaagtctttgaacttctcacaaaatagccacaccacttcgtccccctacaacaaccttcatcctctctacaaggtattctcatttctagcacactcaaatgccatctcttcatgaagccttctgatctatccccaggcagttaattatcccaagccacaagtattttattatcacctctcttcctgtgcttgtaacaccatcccacatctgcttacatatctgttcctgccatagcattagcgtttcaagagcaggcacctgtaccattgacattagcacatttccatccaggcagagggtagagtcccagtaaatggttattgactgaatgaataaaatgaaactgtcatgtttaaacatggcctcaaaattaattatttccctttttttcttttatctaaagtcagtggaatggaaaaaaaaaccaaaaagttgaatttttgtacaacagtttagttttacattattgtctcttctaaaataatttttcagcccaaattatgtggataattgcttcagttctacatcaagtatagtatacacggaaacctggcgttatattattgcaaacttattttccaccagactttttgttggcttactattaacatttttctatatatatatatatacacacacacaaagagagagagagagagagagatttctgagatgaaattggcaagatctctattagcaaagcaataaaactgatcttaagtttaaaaacaatgagattctcagcttatagagctgatttgtaaaatactggtgctgaaaaaccatattaaagagaacacaaagtataaaataaaacaaaggataaccttagaagactcctggttcacttacagctttctttttttttttctatttttatcttaaacaggaggtacacgtgcaggtttgttacctggctcactctcagttttaaagcaaaggtgaaggtacatttagagtcctgttcagatgacataagaggcctggcatgtatttgctcacagctgcttattgaaggttcaacagatgcacagctacctagagggaatttggggccatagattgtaccgctcttgtgtccatgctcaagattgctcattagctcacatctaaattgtggctcctctcagatgggcccatcttcctgattatcctcccagaatgtgggcctcaggcttccttgggacactagccaaggtccctctctatgtccctggtatgggcaccctgttctgagtcccagctctgcagacctctgccccaccacacactgttttctccccaagggttagattaggaaggatttgaatttagacagagccactactctcaaaatagaagcaaacttatggaaatacaaacatatatgattacatttacaggaagagccatacatatttgttttttaaatcaaattataggttggcacaaaaataattgtagtttttgccattgcaagtaatggcaaaaaaccacaattacttgtgcatcaacctaagaattcaaacatatgctgagcacttattatatgggcttcctgttttccctgttctctgtcttcctacatttcattgttcacacagacaacctcactttgcacactgtttccaaataaaaccacttgtactcataacttccaaggtaagacatatgctgcatgcctctgggcctacctctgggaagatttgggacaagtggctggaaaagtctactactttctaagacttctcagagctaacttctgaaagtttgtgttgagatcctaacattctgtgcctatgaaaccaacccatctgatatggtttggctgtgtccccacccagaatctcttcttaattgtaatccccacatgtcaagggcaggaccaggtggaggtaactgaatcatgggggcagtttccttcatgctgttctcatggtaatgagtgagtctcacaagaactgactgttttataagcatctggcattcccctgcttgcactcactctgtgctgccaccctgtgaagaagatgcctgcttctccttgtcttctgccatgattgtaagtttcctgaggcctccccagcaactcggaacggtgagtcaattaaacccctttcccttataaattacccagtctcgggcaattctttatagcagcatgagaatggactcatataccatctcactgtggcaagaccagggatcctattcttctaatgggaccctcttgggagaggcatttggagtcttgtcttactggtctagaaattttgtaacatgtatatctagtcctttgtgttccgatgtggatagcagctgatgaggtttggctgtgtccccacccaaatctcaccttgagtggtaataatccccaagtgtcgagggtggggccatctagagtaatggaatcatgggggcagttttccccgtactgttcttatggtagcgaataagtctcaagagatctgatagttatataaacgggagttctcctgcatgagctcccttgcttgctgccatgtaagttgtgactttgcttctcattctccttctgaatgattatgtggaactgtgagtcaattaaacctctttcctttacaaattagccagtcttgggtatatctttattagcagtatgaggatagactaatacagaaacattattcgtaatagacaaaaagtggaaacaactccaatgtccatcagctggtgagtagataaacaacatggtctatccatacaatggattattattcagccataaaaaagaatgaagtattaatacacactgcaacatgtacaaccctcaaaaacattatgctaagtgaaagaatccagacccaaaaaactacctactatatgactccatttatattaaatcttcaaaataggcgaatctgtagagacagaaaattgatcagtagttgccaggggctgggagtgggcatgaagagttagtacaaattggcccaaggtttatttttgggggtgatgaaatgttctaaaagtaggtagtggtgatggtcgcacaactctgtaaatgtactaaaaattaatagtcgcaaaaataaagagtaagaaaaaagtaaagtagaattagaaaaaaatatttttaatccctgcataattctgagtttaacatgttcatggttattgtaaagaaaattaaaaatagataaatgtattattttaatgttaattacctagggaaataatcaccacttacatttttatatatgtctttctaatttttctctaatcatatgtagatttttaaattaggatcacactatgtttttagttatgtctattaatgacaagatataaagcacttatatatatagctactgaacaacagaacctgtgaaaaaaaaatctcagtgttttttagctaagtggaaatcctgtttggtcaaggtttttcatgaaataaaatccctgaaatttaaatagacaaaaaaacacacacacaaattgtaatcgcaataggtttgttaaccaatgcacacagcaaatcaatatgccatgacaccaggttgcagcagagaaacaggtttaatcatagtgttaatggaaaggggtcatgatccagaccccaagagagggttcttggatctcatgcaagaaagaattcagggctagtccacagagtaaagtgaaagcaagtttattaggaaagtaaaggaataaaagaatggctacgacatcgagcagccccaagggctgctggttgcccatgtttatagttttttcttgatgatatgctaaacaaagggtgaattattcatgtctcccctttttagaccatatagggtaacttcctgatgttgccatggcatttgtaaactgtcatggtgctggttggagtgtagcaatgaggatgaccagaggtcactctcatcgccatcttggtcttggtgggttttagccgtcttctttattgcaacctgttttatcagcaaggtctttataacctatatcttgtgctgacctcctatctcatcctgtgacttagaatgccttaaccgtctgggaatgcagcccagtaggtctcatcctcattttacccagctcctattcaagatggagttgctctggttcaaacaccttgaccacagggtcacagaacgagaagatgggagggaacctcaaagccatttccccaaggaagttgaggcttgggtttttgagggctttggagtgggcagaagtgtggagatcaagagtacagggtgaagtcataggaaggggagaggaagcagctgtgttctcatgctgatcctgttcccctgtgggagacttccaactggtggctggaattctggggaggtgtgtctgaaaaacatcttaagtgtctataggaacaatggggatgcaaatcaattcttaaacagtcttctggccttaatgtcagagatcctatctaggggaacggtggggaagcaaatgtcaggatctagtgctactgtaactgaggaactggttagccactcactgcagcagagtccaattaacaagatccaggcctggtacaagaaaagtgaatttatttttgaagctagcttggaaagacacaaagtgtcctgctttaagtgtgctgcttcatctttggagcaaaaagcagacatgtttataaggttaaaggggaagtgagcaagggcaggaagtccccctgctagcctggtgtcttatctaccaaacagctgagttggcatacagttgagttggtgccttcctgggcagaaataagttgtaaaagtggccaagtgggcgtgttttcaccatgtcctcctgaggccaccccagaagtgggagttccgtggagatgtgctttgatctgcaaattgactgtcaattctggagaagagatcactggggcacgtagatgaccttgccttgtagggaatgtgtggtgagggggaggtgagaggttattttgcatttcaaaaagggctaggtaggaagcaggctgaaaggggaaaggagaagagaagagaaaaaagtaattaaaccacctcagaaaaatcagggtacttggttacggtacatgacctactgcaacaaggaactgggccagggtgcagcctgattaacgctgaattataactgtatttgtacccagaacctggcatgcaattcccgtcaaccctgtggggatggtttcaaaacctgaccctgtttctcattgcatccacacccacagcgtcaaagcaatgccaggagaaccacgcgtggctcatgtttcttggaggagtcctggttcagttctacaggcttcccacacaaagcaatatactgttggccatgtaggtaagaaaagcacaggaaactgttttttaccctttctaccagtgtttagtaccaaccacaagcaccaaaatactcaaacttcgagctctgtggctctggctcttatggacggggaagtgctttacaattgccaggcattccattcactttatagaatagccagaaagctccagggatggggatgccctgccagggggccacagctcttaaacaggtgacatgcttgtgactggaaagaggtcccgatccagactccaagagagagttcttagatctcacgcaagaaagaattcagtgcgagtccattaagtgaaagcaagtatattaggaatgtaaaggaataaaagaatggctactccccgtagacagagcagccccaaaggctgctggttgcccatttttgaggttatttattgatgatatgctaaacaaggggtggattattcatgcctcccctttttagatcatagagagtaacctcctgatgttgccatggcatttgtaaactgtcatggtgctggtgggagtgcagtagtgaggaccacgagaggtcacccttgtcaccatgttgattttggtgggttttggccagcttctgtactgcaacctgttttatcagaaaggtctttatgtcctgtatcttatgctgacctcctatctcatcctgtgacttagaatgccttaaccacctgggaaggcagcccagtagatctctgcctcattttacccagcacctattcaagatggagttgctctgatttcaatgcctctgacacactaatgttagagcaccttggacattttccttaatctgagtgtctagttttcttttctagaaaatgagaaaaaactagaatgtagacccccatgtgctcaaagcaacagcctgcctggtttgcttggacttttcctagactgtatgataacaggtgctcgattcctctacgtaaatcttcaccttttattaatcatattaccctgcttctcttagaaaacgcacagttctgccctccctacaccaagatcacaaaaggctaagtgtaagtcatgagccaaccagaccaagagtaacccaggcaggccaggtggccaacttggccatctcataggcagttatcactgctcaacttgaagaaatacaaggttaattattggagtttgaaatccagcagtggaatccatgtggtcctatcgtggtcatataatgtgctgaggctcttacaagttgtcagtgctgagtgggaacgacaaagccagaaacaagggcaagcagaggttgaatgccaggaagaccgtggcagggtgccaagtccatgaagcaaaagcaccgccatggtctaaaaggcatagtcctctagagcaacagagccagtaactcagatccaaaggaaagaaaatgataaccctttccccctcaagacttgccattgtatggcagcaggagggctgcttgcaaaataaataacccaccaacatttgtaggttggagatctctcagtcaagagtgacaggctgtcactgaaaatgggtcggaaggaaaactgtcattcctactaagcaattttaaataggctttgtttccagatatctgtgcctacaagtcctcatttcctcatttggaaatgggatttgatatggttgtattaggaggtaaaattaaaaatatctccttacatcccattcacactgctgcatgatggaattgccaaccttgtaaccaaaacacatgtctttctaataagaagtcaatgacacaagagaaaagagattcctgcagctaaggtttgctcctggtattttccccatgatatcacccaacacaatgtacactctgtgggtggagaaggatggggggtgactttttagcttgtatacttatttgagaaccttaaatgagatgcctattaaactatccatgtatacaaatagactcaatattaagaaaagaagtagtataagactgaaagacatgcttaagagaaaggagggagccatacttcaggaatggagaaatgaagaaaaatctatactggctaaagtcaggttagctaggagggaacatatgaggaaggcccaagtcttatgctgctagaagccagggcagaggcagtaggctggaaaggaccagtggtcatcttggaaatatgtgctccacttgaagccatttggataaaaaataagaattcttagaacactggacatcccagaaacacgataaattagcagaccaaatgccagtctgcaactgctggttaaaaagaaaaatccaattacttataacactgaatataggtcagcagaaactcccggcatcaaagaaactctgaccataaagacttagtgtatatttttacaaaacacttcacagggccttgtggatcaatcatggattcaattttgttctacaaattaaaatcaagccatgtttaaagcaatctcattaagtcgcttgccaacgggtgcacacagtaccacactcctggtgtgacatgaccattcttatcattcatttttggaaccctcctttcatggatacaccacccctcacctcacttccctgcttctgccttacctgtgctttccctgtggcttacctggattatcacaaccagatcccctgcagttttcagccttgccaacatctgaacatgtcaaagaaaaatgggcaggacagagtttgaaaggcaaagcctttattcaaggctacaataagggagagagattgaactaactctgctgaaacaaacaatgggacgatttttaagagctgggatgagctaatggaaaagtactggaagatgtttgtggggaggttggtccatgtgattaggcatctgtgtttgctaatgggtgtttactggagttaggctccaacccttccacagagactgagagacagagacactattcctttccatgattacatttcaaagagatgtcaggtccttgagaaaagtggtcctgggttgcaaaactagcaacaggttggaagatttacatctcacagggacagagaaagaatttacaattgcaagtttctaaagtaaatgcttcaagaaaagagaagtcaaggcctatattagtccattctcatactactgtatagctactactcgatactgggtaatttataaaggaaagaggtttaattggctcatagttccacatggctggggaggcctcaggaaacttacaatcatggtggaaggcaaatgggaagcaaggaccttcttcacatggtgtcaggagagagaagtgctagcaggttaaatgccagacacttataaaaccatccgatctcatgagaactcactcactatcaagagaacagcatgggggaaaccacccccatgatccaatcatctccctccctcaatatgtggggattacaattggagatgagatttgggtggagacacaaagccaaaccatatcagggctctagagtctgaaagaagcccatctaaagtgtagtccagcacaggggaaggttatggccctcttggtcaagcctatctatccttaggaggtaaggaagttcttctagccttgcctcaaacccagggtgagcattagtatatggtgattctcctggtggctgagccacaggctccaacactgttccccagtcatgaggctctaaaccactaccccacagaggcccatttctataataaggtcctgctcccaagcttcctcctttctctccatccttatccctcccccttccctgcctggcatggtcttgtagctggaagacgaggcctcagctctggggtctcatttctgcttcacaaacctccatcagcacagactgtccccatgtggagcccagccccctgctgttatctctgaaaaagatctactcaactctataatcattttcggctactgagctattcgtcctacagaaatagtaaatgctattttactgtgcatggccggtgataccagcaagcctaggacattggtcccagcgcctatcctgcctattgtcctactacagggacaactatgactatgctagctggaaatgatgattccttgggtacccagcctgactatgacacaggctgtcatagtcatttccagcaagcaaaataggaacaggaagctaagaatctcaaatacatttagaatgacctagtcaaatgccatttctttttttttttctttgagacagagtcttgctctgctgcccaggctggagtgcagtggtgcagtctcagctcactgcaacctctgcctcttgggttcaagcgattctcctgcctcagcctccagagtagctgggattacaggcacgtgccatcatgcccagctaattttttgtatttttagtagagacagggtttcgccatgttggccaggccagtgtcaaactcctgacctcaagtgatctgcccacttcagcctcccagagtgctaggattatagacctgagccaccacacccggcctaccatttatttgtgaaaaaaaaataaaaaattccacttacatgggttccccagagtcgtcagattcatagagacaaggagtggaatggtggctgccaggggccaggggaaggggaatggggacttggtgtttaatgggtcagagtttcagttttgcatggtgagaaagttctggagatgaatggtggtgatgttcccacaacaatttgaatgtacttaacaccactgaactgtacacttcaaagtggttaaaaattgtcaattttatgttatgtatatttcaccacaatgaaaagaacagctcataagaaggaagctgtaaatagtaataataataacctggaattatggtttagggattatagcttgctttcatggttaaaatgagagcctgtaagactcaagctatgtaataaaaattctggtggagaaagtataggttaatgcttgctctagagaaggaggcctgacactcacggtgtccatttgagcctgtcctaaatctctctggacctcagcctcaccatacctacaatgaattggcctcagatcttctgctctgatcttgcaccaagcctgggcttgcaatctgcgtgtctgtggactcttcaggtatatttctgaatgcaggtgcgtttctctggaggcaggggccatgaccttcagcagattcccaattggaaactcacctcccaaccacgttgaagacctgaaagctggaatggttcatctgtcagcagtccttacagctcctaacattataaagacagaagcccctacaaactcagccagacccccacatgtttagaagttagacttctctgatccttaaaatggctaccatgagaacatggcccctgggctccctccagaagggagctgcaaagagggagtcccattctagctccatttctgggtgttttgctcaaattgacctgttttccctattgaaagagaaaattccggccaggagtggtggcttatgagccaagatcgtgccacactgcactgcagcctgggagacagagcgagacgctctgtctcaaaaataaaaaaaaagaaaaaagaaagaagtaaaagaaaagaaagagaaaattcataaaggagggaccccgtcttcactgtgccttggttttgattcttggttatgagtggttccatggtggtggaggctgctgatggaaagaggaacagaggggtgagggatttttgctgaaaatctagagaatacttagaagcccctatatttcctgggccccagaaatgattggagccaaatgggcttgtgaggaattttgaaattttgaatttcacctgaattttggatgtgatttttctctatcccgtgcatagaaactgagagaggctctttccctcaggattttgtgaatcttgtctttaactcatcgcccaaagtaacaaactcatcttactaacttcagaaaaagacatcaccagcctggcctgggaataacacataggaaattgaagacagtagtatacttaagttcacaaaaggccaattcttatggccgtatttcaaatgctcataacgccttctcatccattctaccaaatgacttgtcttcataatatattcagagtgaaaaaacataatggattcttccgagatattcaattagttcaataaaaagagaaaaataatttttcagtaaagaaatttaactaaatgactaaaactgacagtgaaaaaccaacttcaaagtaattatgcatttcttttgagtttgcgctctaacgaaagttgatgatatgccaccattagaaatagccatccttcaaatgatcaattgcatttgtgttgctattttagcagacatttatttgaatgtttactctgtagctgtctttgggtgttgatatatttaaatttccaccagccccgctaaagagtatcggctcgcacttcttcatgactcactgctcagcttcctttaagctggttttttccccgttaacagaaacctcttccaaaagtgtcaccagtaacattctccttacaaaatccggttacttctcttcacttcttatcctcgtaggggtcatgacacatttaattatgggtcattgactcctcttccaattctctcctgcaaaactagcatctgctctttaaactttggggtctctcaggattccgtattccacccctctggcattctgaactttcaccctgggtaaccactttgttagagaagtttcaaagccatctatgtgttgatgacttcccaacccctaactcagcctgggcacttccgccaagctgcacaggtgcattgaattcaaggggtcgttagcacaatcaagactgaaccgctggtcttcccacttcccactgcactctgctcttcgggcagcctcatctgagtgcttgatcaccaagaaaagacactgctttcctgctcgagctgcacacatcatgcctctcttcatccatggctggtccgcctgcctgcagggtctcacatttcctatcaatccaatcgtgtgctttctgaagataagtcagatcagattgttcctggatcactgcctttccggaaagcctctggtggcctcgtgcactctgtagaattggtacaggtcccttgtgatgctactcaaggccctccaggagcccatgccatcctcagtgccctcagctctggaggagcagctccaccacggcaccccatgactttgcatgtagagccacatggggagggtatgacctgcagctgcgctgagtcttggcagaacaccctgcggtcccccagccagtttctcattgccttccgggttctgtgaggtgcgggggctttctgcctgcccctctcaggacacagctgctgctgtaaaactgctgagaagcagcttggagttggctctactgcaacatcccttctttctgttgcagttgtccattcccttttattctgccatgacctgcgccaaggccatcatgcccacgcctgcttctactgtctaagtaataagctgtctgcatctaaagaggtctccttgcttctttgctaggacttgcctgcgtcctgtatgccaacttcaaatactcactacccttctaacccccgtgtaacctgatagcctaactgcaaacttaatatgcgtttcaaaacataaatatagtacaagagaaaataaaattatacttggaaatctggctaagtgaaaataaggattagaaaaataaaagaaagccataggttagattagtactgtatagtattagtttattaaactgataagaacagatctgtacttcatcttagccaagaggccaagaaacgattgtactactgtataaaattatggtgctgtaattttagaggtgcttcaaattattttgggaataaggcaaatctgtatacttaaaatgtgtgacctatgaatttggctctaacctttcttgcagaaaattagaaactactaacaaatggtttgtcccaagagcaaacctctaatgcacaaatgattaaagatgaactcagagaaaaatgaaggcaagctgagttttattaacattgtttaatgtttaagtgaaatacattattagggctgggcacaatggctcatgcctgtaatcccaacacattgggaggccgaggcaggtggatcacttgaagtcaggcgtttgagaccagactgaccaacgtggtgaaatcccatctctactaaaaatacaaaaattagctggacattgtgttgcacacctgtaatcccagctacttgggtggctgaggcatgagaatcacttgaaccgaggaggcagaggttgcagtaagccgagaccacaccactgcactccagcctgggtgacagagtgagactcaccaaaaaaaaaaaagaaagaaagacattattagattggtgattatgagggccattatcttaaaatagtatttcctaaaatgaaaaacatttcaggaagtagctgaaatatcaggaaaaaaacaaggctttaaaaataaggtccaaagattatatgatgattgcttctatgcccctgtagccagctagtgatctcatttctcatcactaacccagctttctaaatctgtcctgtccagcagggtcagccatcccagcccccagtggcaccatcagccatctgagactctttttcacccccagaagaaaatgtcttggatttaatctttccctctttagtcaactcctcagttagagtagagctacagcagtgaaaccatggccatctctcacggagactccgtcctccccctgccaccaacatgtgtgaatacctggctacttatgtaaaagatttaatttgataagtgaggaaaagtcatatttatctccattctttgaatagatttcagtgtgtgagaatgactttttagtgtgtgtcagaagcttagtattctaagggtaaagtattaagcctaaagaacttcaatcagaagtcttaaggccggatgcggtggctcatgcctgtattcccagcactttgggaggcctaggcaggcggatcacgaggtcaggagtttgagaccagcctggccaacatagcgaaaccccatctgtactaaaactacaaaaaaattagccgggcatgatggcaggtgcctgtagtcccagctactcgggaggctgaggcaggggaatcgcttgaacccgggaggcggaggttgcagtgagtcgagattgcgccattgcactccagcccgggcgacagcgcgagactccatctcaaaaaaaaaaaaaaaaaaaaaaaaaaaaaaaagtcttatatatgataaagggctttgtaaaccactaaactttataccaaaaaaatctattattgttagtcttgtttgcaactattaataacaactgagaaatgggctgggcatggtggctcacgcctgtgatcacaacacttttggtgtctgaggcaggatgattgcttgacgccaggagtttgaaatcagcctgggtaacatagtgagacaccgtctctacaaaaaatacaaaaattatcctcttagatgtaaatgctaaaaaaataaagttagccaggtgtggtggcgtgcacctgtggtcccagctacttgggatactgaggtggtaggattgcttgagcccaggaggttgtggctgcagtgagccatgatcgcaccactgcattccagtctgggcgatagagtgagaccctgtctcaaaaaataaaataactgcaaaatatactaagtttacaatgcaaaaagtgctatggtaaattgctctcgcatataccagttgcataccaacatcttccctttttcccacaggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacagtaagtctggctaaagcatttctgcctattcttccagctttcagtttattttctctttcccaaaatgctgtttctctactgttctctcaagtattctcatttggttcattttaagttattggcatattataaatactgagaattttcccaccaacaaacaaatgcaatttataaaaatattgaatatctgtttcaaacacagacattttctcttctgcttcctctctgatattttctatactgtacaccctgtgttgtatatcctaacctgtctgctacatacactatttagtataactccaatattctatctttaaaattttcatatatttagggggcacaactgcaggtttttacatacatacattgcatagtggtgaaatctaggcttttactatccccatcacccaatagtgaactttctcttaactaatctgtagtttctgccatcccagagttcccagccacaagactgtgattctttgttcttcctctttctcttccttttttcttttaattaaactccacagattctttgtttgtaactagcttacaaagaatattggccaacctgcccagtctcagaccttgaaaagataggagtctctgcttctccccagctatctcttggctcagctgtctttccagtctcagagacagagaactgtgttaacattaactttcaccagcgcattggagaggcttttcgtggtgtacctgctgtcataaaagactaaaggaaagagaagtgctaggataagaatctttatagtcttcaacctccaaccttccatagtacgctgcagacctcctcagacttgacttggtttaatgatgaccttgggttttttttcaaatccttggccaccattgactttgatgtcttcttccatgcatcttctttctcctttataaaacttgcaagcaatgtctcctcccacaagtccttccacataggcaggtggaattcaaaacttaacccaacttctatcacttgccttattaagactgaaacaccaacatattaatatggagtatccctatatccacaatctcacccactttcttccccaaatgtaaactaactaccaagttcaccttgtcttccaataaagtaaaagaaaaaagaaaaagaaagacattagacactatgtcttcaataatatacttatcctgctgttgaccccgtcagggttcccacttcttatgtcagtggtagaacttttgagggagacagagaattacgcatttcattaggttttgcaaatgtattgtacaattgtgcataacattttctatttaaaaatctcatatctattgttatagccctatctcatatctcatttttttagtgccttttgcttgttattgattctatttgcctgtttgtctattttattgctttttaaataatgaattctgttatactgattatttttaattaaaacagaccttctcttgtttgaggggttagtgttttatttgctagtttttatggctatagcctatttgaataatcatctccagttctttccaattggaactttctcattcaagagtttcttttttgggggcgtgcagaggggggtgagcatcaggataaatagccagtgcatgtggggcttaatacctaggtgatgggatgatttgtgcagcaaatcaccatggcacatgtttacctatgtaacaaacctgcacatcctgctcatgtaccccggaacttcaattaaaaaaaaaaagaagaaaaaaaaaaagattgtatcctctactaaaggaagatgggaaaatgctgtttgatttaatctgccatctcactaggtgagcatcacattagtcattgctgctcctgtcaccttctggtaatgatcatgcttcatgtatttttatttccctgtcattactctcttgttttttctcctggttttacctaatagataaatgccttctaaatgattttgttgtctcacagtttttttttctgaatatttagccctgtttattcccagaaaggggcacttaaaaatacatatgaccctaatcatgtgagtgactttatctcaaggctaaagaataggccagctggtgcagccactgccaagtgtcacccaggggcctgggtgatggtggctattgccaccgcacatgacatcagggaagtggaggggaagcttaaagatccagtctctatgttgcgggttcccacccaaatgtagagctgtggacagaggattgatcaaaaaaaacaaaaacaaggctggactcagtggctcacacctgtaatcccagcattttgggaggccgaggcaggcagatcacctgaggtcaggagtttgagaccagcatggccaatatggtgaaaccccatcagtactaaatatacaaaaattagctgggcatggtagtgtgtgcctgtaatcccagctactcgggaggctaaggcaggagaatcatttgaacccaggatgcggaggttgcaatgagccaagattgcaccactgcactccaggctgggcaacagagtgagaccctgtctcgaaaaaaaaaaaaaaaaaactaaagacaaaaaatgtaggctatagaacccatctccatgataacacattagggtcctgcccacattgagagcaggtggattttcaccttagctttctagatgtggaacgcagtctttgtcaagatggctttttcgtgtaataaatttgcagggaggagttcttggtaatcaatcatcttcatgaaaggagctctccttgaaactgattataatcgcgccgaggcacagaactctggtgatggaaacactctgtctctgtgttgttcattacaggagccagcagccatgtgtggcttctgggcacttggaatgtggcaggtgccactgaggatctgaactggtattttcacttgatgttaatgaatttaaatgtaagcattcgcacaattataaatgaaaatgcaatgcctgtttggtgtgactttcatcaccaaaacctcactcttttattggaaaaagtctcatccactctcaccagaaccctccttgcctttacagatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaagttgacctaactccagtgcatgcacaaacaggaaattgtaacttcactgggttcgtgaagccagcattttcccatatacctttccaagaagatgtttcccagaagaatcattcatctttagtgtatgtctgtatgatagaacatgttatatgtaaaagtgctcccactgatgtttaaaggcatcttaacaatccctgccagccagtctgagggattgtgcaaaggtgttcattgctagcctgcaaactaggtggtaagcaaaacttcctacagctgccactcaacttgagctaatgaaaatgcgcccagattagttaactagtctatcagaggcctgtttctctctacattatgcagaataatcttttgcaaggttaaaacagatattatgagactttctgagaatagtcgtgagaatttatggatggagggtgggctgcagggaaaatgataaatgcataatttacactgttttttcactggctagtaataatgactataatatcatgaaacattgtttttaacaaatgaattattatgccaagtagtatagatgtgaggataaaattaataaatacatgtctcagatattccttatttatgaaatactagtccaatgttaactttagccgttattcatatataactgttaccatccaaaagccttttgggccttgcaatttaccttttgagaacgtatcggtgtaattgtgaattaggaagttgggaaattgacagaaaaagaaaacagaaggttttttatcctactgacagtggtgagctgccaggaaatcacatagtacaacattggacattcacgtatataaagctctgtgcaagaccagagtcctgtgagtagaaggaaaaatgaagggccaggcacggtggctcacacctataatcccaccactttgggaggtcgaggtgggtggatcatctgagatcaggagttcaagaccagtctggccaacatggtgaaaccttgtgtctactaaaaatacaaaaattagccagccatggtggcacatgcctgtagtcccagctactcgggaggctgaggcagcagaatcacttgaacccgggaggcggaggttgcagtgagccaagatcatgccattgatctccaacctgggtgacagagcaaggctctgtctcaaaaaaaaaaaaaaaaaggaaacaagaagccattatagcatttcactggcccttcagactgggcatttctgaaagcgaacatatcatcttcccctcctgacctgcccctctgcctgacttgtctctgatgactgtaccaccaccatcatcatcaccatcatctccatgtctccttcctggtcttcccactgcaaagcccaacagagtctaagggtccaacactttccatccatccctgcctccaccctcctgtctcaggtactaatgtcacttaacctcgattatctcactggctttctaactttatcttctgcaaagagagagagaaaatagaaatcaagaggccacccctcggaggcttctcctgagtcttttctgtaaagcagagacaatttcagatgaagggttagagatgggagtggggactgagaagaaattaggaaaccttgtcaaagcacagataattcggctgtacagcaattgggctaaacgttgagcaggggtggtccagaggagtttgtatactgtcttagtccattcgggctactataacaaaataccataaactgggtggcttataaataacagagatgtattgctcatggttctggaggctgagaagtccaagaataagatgctggcagattcattgtctagtgaaagcccacattctggttcacatatggcgccttctccctgcattttcacatgatgggagaggcaaggcagctctctggggcatctcatcccatcccatccatgaggacactgacttcctgacccactaatttcccaaaggcccaccctcgtagtaccatcaccttggggatcaggtttcagcatataaactttggaggggcacaaacttcagagcatagcagataccatgaatttatagcaacacattatgcttgtttgcccccttgctttgctgacagatatcctagacctagatttctagagtgtaggaatgttcccttcgtgagggtatgctgtctggggcctggtttgctgagtcatcactagcaacctgcaagtcactcttgcatagtatcagctggggagatggtggtggatctcaagtctggctgcacaacagaagcacctggggaacttttaaaagtagctacccatacctgagccctaccctatggctggaagggcagcttagacatttgtccattttaaagcctcaccaggtggtccgaagacactgggaaatcaggaccgtcctggtgagtgactccaacgtttaggtacaggctcctggacattctaacagtgtcctccaatcttgtccccaccctaaagacgtgctggttccttcggttcacaactcaataggaaacaggtggaggagagtaaagttaagaatacaagtgtgaagatgtttgctaccgatggtgccagaaaacctggcaccatccctcctccagagaggagggtacggtgagatgacagaacacatccagtatgagaatttctatagcaccaactttccagaaagtgtttcagaagcttacagaattaaaatgtgaaccagacaggaagttaaacttgacaaggaagagaaaccaactaggaagagttggggatggagttaactgacactaaatttggcctgagcttctcattggcttgccgtacacaattgccactgtgtgataagagcaacgtgttaattgcagtggtagttcctaaatgctgctgcacgtcagaaccacttaggaaacattttcaaactacgaattcctgagctcagtgccctagaaactttcatttgtgctctagattacgacttgagcttgaggaatagggcgttggggaatggtaatgaatggacgcatggacagacagatggataaatgaaaggaaacatatttctccctcttttcttttgttctttttttcttctttcctttgtctttcttttctttttttcctttatttgtttacttatttatttatttttttgagacagagtctcactctgtcgcccaggctgaagtacagtggcgtcatctcagcttactgcaacctccgtctcccgggttcaagtgattctcctgcctcagcctcccaggtagctaggattacaggcatgcaccaccatgcccggctaatttttgtatttttagtagagacgaggtttcaccatgttgtccaggctggtctcaaacccctgacctcaggtaatctgcctgcctcggcctcccaaagtgctaggattacaggtgtgagccaccacacccagctccttcctttctctttcttcagaaagtaaaatattacaggcaaaggtaaaattgcctatgtttctctgcccaattttattttctgttctctctcctcagaaacaatagctaccatgaattagctattcatgtgtgtgtccagatgttttatccttttactacacacaaactgacacatacactcactcacacacattcacacatgacacatacagttctattttgtgcagtttgtaaaacctcctgtaattcatattatattgggcataccattctgcgacttacttttcttcctacctgtgttacattcacaaggtccatccacgttgctctaattcagcgttcagcaaactttttctgtaaagggccaggtggctttgtgggccatattagtctctgtcacatattcatctttattgtttgtttgtttgtttgtttctgtcttttgtaccaccctttaaaaacgtgaaaacccttctttgcctgggagctatccaaacacggacttgaggttagagtcagcccacagcgttccttggctgaaccccgctctgctccatttactcctcctgctggaggatcctgtcatttgaatacggtgcagtggattcccttatcagcagacacattcgaatcatttactatgaccaacgctactacagtaagagatctacgttttccaccagcttctggagtgagcgccagacagaccacaagcccagcactgcccaaagaccagcacttagaagccactgctctacaagcaatgcttgcagctaggtgcggtggctcacccctgtaatcccagcactttgggaggccaaggcaggcagatcacttgaggtcaggagttcaagaccagcctggccaacatggccaaaccccgtctccactaaaaatacaaaaattagccaggcgtggtggcaagcacctataatcccagctactcgggaggctgaggcaggagaatcgcttgaacctgccaggcagaggttgcagtgagccgagatcacaccactgcactccagcctaagcgacagagcaaaaaacaacacctgcagagatccaggagcaactggaactcaagaataacagagtttggataaatcggagagcagtacttcctatgtgattgcaaagagataaaaattctatgtgtgtgtagtgggaatgcatatacacacgtacatgtatgtttgtgtgcacgcacgtgtgtgtacccagaaagtagacaattaagggggttacatcacacattgccctctgtaaatccaatttctgaacatcaaagcctcactccgtgacatctctttgaagaacaaaggcactgcaggaccctgctcacggttcagctactcgggactggaaatgagtgttttaaatggagaccagagccgctgtgcacctgcttgttaaaatacagatttccaggcccatccaacctatggcatcaacatcccaggtgacaggggcctctagctcaaagcccagtgtttggttatttttatacaatatttttataataatacacattctgctaccaacactccccatatattaagtattagtaaacattgaatttttttttttagattaaaaaaaaaagacttggcagtatttttttcttaccaacaagggattttcttgtggtcctcactttgagactcctgatctacagatgacaatcatcagcaggttgccaaggatttcccacttctcatctctcaactgagctcttgggtcaagttaatctaaggcagaattgcctgataatccctaaagaattgcttcacagttggtatcattgataaaagacaggcacaggtacactagctgtgaaataccaaatgtgctttatgtgctcgtctaaggggagccatcccatctagcatctgatgattgtatctcactgtaagtaggggcacctgtgtgtaaagtcgaaattattcccacagtgaaactctggatctccttgtgtagctggaaagtattcagttgacactccaatggtttgctgtacaaagacagtagtttcagcccccaaaaaacagttaaaaacaggtgttaccacttaccttcaaaaacacacttggtctggtcatgtgtaaaaggcataagattttctaatattgttcatttaaatgttagagatgcctgccaaatgtcatgatttacgttttattatatacctagtccaagacattcttcctaaccaaaaagggatggacataataagacatgtaagaatctgggtcagaggtagcaggaacaggtaaccaccagtgcccaaccactcaaatgcataaaagcagacatcaaagtggccgacccacgtgtgctaccatttatatgacattgagaagaggctgcacagaagtgagcttaaacccttaagcaaggattggagaaggaggagggtgatttcaaaaaacactgaaattagtagctttctttttttttgtttgtctgttttgttttaagactgagtcttgctctgtcacccaggctggagtgcaagggcgcgattttggctcactgcaacttctgcctcccaggttcaagtgattctcctgcctcagcctctgaagtagctgggattacaggcacctgccaccacgcccagctaatttttttgtatttttagtagagacagggtttcgccatgttggccaggctggtctgaaactcctgacctcaagtgatccacccacctcagcctcccgaagtgctgggattacaggcgtgagccaccacgccaggcctgaaattagctattaaagtacataacttcctaactcagccatagtccttacaagaattttgggagcaaggaaatcagctggtagaatctctttgatgtttctttaaagcagggtcagcaaactctaagacacagaccaaatctggtctactgcccatttttgtaaataaagttttattggaacacagccgcgcctatcatttccatatcgcctgtgcccgttctctgctgcagtggcagagctcagtagctgccaccgagaccagctggcccaagaagccgaaaatattaactctctggcccttcccacttcaaagcatcattcataaaacttcagtgtgatgtaggagaagataatcacgtcacattcatggcaagaaaaaatactcagatccaagtagactggcagcaaccaaacatgctgatgtgtggggctgttttctgtattttcttcagtggtctggcagttgtcccattttctagatgagaaaactgatcctcagaaaggtctccaggtgagtaatcagcgaggccagcattcaccattgactgcctcccttacagaaaaggataataacaacatttcagtttagtatgacctgatcctgtaggtggctttactgcaactgagagttgaactgaaggatctgcatttctttctttgacatctgaaaataaaggaaataaaactactgatattgaaagtaataaaaaatgaaaatgaaatgatttttactgtcagttttttttgttttgttttgttttgttttttcacagagtcttgctgtgtcacccaggctggagtgcagtggcatggtctctgctcaccgcaagctccacctcccggattcacgccattctcctgcctcagcctcccgagtggctgagactacaagcgcccgccaccatgcctggctaatgttgtttttgtatttttagtagacatggggtttcaccgtgttagcctggatggtctcgatctcccgacctcgtgatccgcccgcctcggcctcccaaagtgctgggattacaggcgtgagccaccatgcctggcccggttgttgtagtataaagtgcatgtcagtggcatgaagtggatgtgtaattcttcccctagcaccctcccagtgaggcaagccggcattgccattaagctgtttctgtggtttttctagcacgacttttatggtatggcaagtctcaaaaaaagaacttgtcgggaaaccatttctgaccattgctttctgcttaattaaccagtattagcaagaatgtaaaaggacagatcaggtgaactatcttaacaaataccaaaagtaaatgtctctatatggagggtaagatgtagacaaactcagacacaataaagaaatttaaagaggggagtgggcagggcacagtggctcatgcctgtaatcccagcactttgggagactgaggtgggtggattggataaggctgggagtttgagaccagcctaggcaagatagtgagacccccatctctgaaaaaaagaaaaaaaagccccaccccatgtcagctaaaaattaacattaaataaaatgtggaccaggcacggtggctcacgtctgtaatcccaacactttcggaagcctaggtgggccgatcacctgaggtcaggatttcgagactagcctgaccaacatggtgaaactcatctctactaaagctataaaaattacctgggcacggtggcacacacctgtaatcccagctactcaggaggctgaggcaggagaatcgagtgagcttgggaggcagagggtgcaataagctgagatcatgccactgtactccagcctgtaggacagagtgagaatccatctcaaaaaaataaaaataaaaataaaatatgcatgcctggctgggtggggtggctcatacctgtaatcccagcactttgggaggccgaggtgggcggatcacaaggtcaggagttcaagatcagcctgaccaacgtggtgaaaccccatctctactaaaaatacaaaaattagctgggtgtggtggcacacgcctataatcccagctactcaggaggctgaggcaggagaatcgcttgaacccaggagttggaggttgcagtgagccaagactgcgccattgcactccagcctgggcaacagagcaagactttgtctccaaaaaaaaaaaaaaaaaaaagccaagatgagcaaaagatagccagtaaacacttttaaaattttatttttcaacgtattgtttgcataaaacaaaatgcatccgttgcaagtgtacagtttgatgcattttggtaagtgtacagaattttataccacgccctagtcaaaatacagtttcctttgctattgatcccctttccgcaatccaggctctcattgatctgctttctctaataatggctttgtcttttctagaatgtcttaaagtgtaccagtattttgttcctttctattgcgaaacgtattatggacagacacggcctgcaaaggcattaaacccaggtagagtgggctgtcttcggcctgcagacggccgcggtcatgctttgcagaggagctgtggccccttaaagtgacatgacattatggacaatgacagttgatccttgggggctttccatgcaccttgcgcatgcaagctaagggctttacataaattaaataaatttcctcaagtaaccatctcaatagccctgggacgagtcacttatgttatcatctaaattgacttaaaacaggaatttgagactctaatttgaaaacaagagattggagcctatttagtggattttatgcagccaaagatgtttcttgttgttgttgttgttcttgcttttaactaatttgcctcccaggagacagttgaaatgtctagagacattttgattattatgcctggcaggacgccactagtggcatctagtggatggagggtaagggtgctgctaagcgtcctcccatacacaggacagcaccccccacaaagaattatccaaccccaaatgtcagtagtgctgaggctgagaaaccccactctgctctctaaccaaaattagacacagaaagtggagacattctaccaccctgacaacatcaatggcttttgcccatttaaaacaagaaagaggaatatgtatccaacccaaaacaacatcttaacattctttctaataggcttttgcaaaaatagttcatattttataactgtcttgcagcatggggtataagtgtaatcattgtaaaaatgaaacctaatcattgtaaaaatgaaacctaatcatggtaaaaatgaaaagagtgcctcaaaacatctgaagttcttagcagagggcagcctgtcttcagtgggcacttttggatggaggcaggactagggtatcagtaggagtgagaacaaaggtcagaaaaatgagtacacagcacatgtatactgattaatttctttcttttttccttcttttgatggagcaagactgtaacagaagcctgagagtgaggaagggctttgccaactattactgtagacacagtagtttactcaattttatgaactcttagtcctgggctggaattcacgcctctgctggaattgcacagacaaaacgtgcttgcgaggagtaaggtggcaacaaaagaaaaatgcaggcaaaaacacgcctcattttgaaaccggatctgagcatcctagagccagagcctctcccagccaacattgctgagttgagcagagtgacagactccacactggagccagccccgcagctggccataaggaggagccacgagcaggtgctgggaagacaggctcttgaacgcacactatgctgatgtctctttctgtgaagttttctacatgagtgacgttctcaaagtctgcaacacagtctgccatgagatgccttttttcctctgggaacacaatgctactttcgtgattggctgagtaatggcccccaaagatgtactcttcatcctaatccctggaacctgtaaacatgttaccttatatggcaaaagagacttcgggcaggcacctgtcatcccagatactcaggaggctgaggcaaaagaatcgctcaaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggacaaaggaagagtcgattagaaacagaccatgtgatgacagaaacagagggaggtcagaggtgaaaaagagaagatgctgcagtgctgcctctgaagatgaaggaaggggccatgagccaagggatgcaggcaacccttagaggccaggaaaggcaagggaacggatgctttcctagagcctccagaaggagcacagcctggtcaacactgatttgagccccataagactgagctcagtcttctgacttccagaactgtaagagaatagattcgtgttgtttgcactttatggccatttgttacaggagcaacaggaaattaacataccatgtttgggccaggtgcagtggctcacaggtgagcctataacccccagcactttgggaggccaagatgggaggatcgcttgaggccaggagttcaagaacagcctggacaacatggcgaaactccatctctataaaaaatgcaaaaattagccaggcatggcggtgcatgcctgtagtcccagctcctccggagactaaggtgggaggatcgcttgagcccaggaggcaggggttgcagtgagccaagattgtaccactacactccagctggggcaacagaatgagaccctgtctcaaaataaaaacatatcatgtttgaagaaccaccaataggtatcttgctctgtgacttgtgatccttaagtcaacatatatatatatatatagtcacaggaagtcgatacatatatgggataatcaccaatctctaagatacatagcatgctcataaaatagccaagctctgtgctgagagacaaagacataaggctcattggtaacggtggtaatagcagctctcggtctgagcgatgtttggcatctgaagtcaccattagcattttcagagaagtccagctttttaccatataaccattcattctgtcttccaatgtgatccttaaggaaaaaaaaaattcccccatagtcgtgtgatgtttaaaatgtgtttattataccttgcctgtcatttttctggcttttagctaaaatgttttgaattgagtggtgatattcccgacttaactctgaaccctctctattcaggtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaa

SEQ ID NO: 1963 - DNA, 1169818 bp, Homo sapiens; identical to SEQ ID NO: 1962

SEQ ID NO: 1964 - DNA, 1169818 bp, Homo sapiens; identical to SEQ ID NO: 1962

SEQ ID NO: 1965 - DNA, 1169818 bp, Homo sapiens; identical to SEQ ID NO: 1962

SEQ ID NO: 1966 - DNA, 554233 bp, Homo sapiens
caacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgtgtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttggggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaacccgggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgtgtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggatctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttgggacctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacgagccctggcacaccagtgtgttggtacaaaatgtcatcacgcaccagcagccaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggggccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacagctgagcatcatcattccatgagtgttgctccctcacggtatagacataaccagaacgtcacaataacttactctacttagacttgccaaggcctccgggaacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccgatctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagaggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtgcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagtgcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagacacaaccaagtaatttgtagctcttgccaatttctgtgatgtaaatactcccgtcatgggcaatttgaatctgccaacctgagagtttcctaaaaacttaacaaggggctcttgctacctgatactaactggctccagcacaccatggacctggatcctgtttctagctcaccccctcactcgtggtatgaccttcagcaagcagcttgaatgttttcatctgtaaaatggaccaggttacttggaggttcaagtgagtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccgggttcacgccgttctcctgcctcagcctcctgagtagctggggctacaggcgcccgccacagcgcccggctaatttttttttttttgtatttttagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactggtgagtttaaggaactgacccaagatcacagaataataagtggtgagctgggatttgcacctgggtctgtgcgtgggcgagtccacctggggcccgtgtcttcactcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatggtctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctcgggattcatgcctcataaaatcatttgatctggtgggatctcatcttcttaatgtgtctgcccatcatctgttcctgggaggctttattagggcagtgtgtgcgtgtgtgcgtttgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccggggtcatttgtgttctttgtctccatgtccttgcttttgaccagggccaaacaacccacctgcactgcatggttcccccagcaagaacatcccagtgagaatggcccacagatgcctgggcgtgacccacctgcagcttcaaccatgcaggtaaatttgcctgctgctgtgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccacagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctgatagcagagaaagacaggaaacaagaaaaataaataaatatggtagttttgcgtagtgatagtgctatagaaaaacgttcaaatggggtagagtgatagacagtgttgttctgagcttgtccaccacaccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagccatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagagtagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtatgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattactcagcactgactgagtgctcaacacttttctaggcactgggaatacagaaatgagtaagacaggccaagtccctgctctggtgagcttatgtactggctgggagagagacaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgttctttttctctctctctttggtgggagagctggctttccattagttaaatgtgcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacattagctctctgtaaataaaccccaaacctgggaatcatatatcttaaccggctaagctttatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtagcctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaactttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattcagtgctcatcactctgcaaatcaaggccccccgaactcctcccacccctgccttctgcgtctccctctgtgctctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggaggctttatggaggcaaagctgaggggctgtacgtgtcttcataggtctccagtctgtaaaagcaaccacgctttgggctggggcagaagtcaggacttgaactggctctggctgggacccaggctcccaggtagccagctcccaggtgacaggagtccgctgggctccctctgattcttaaagcctttccaggtagcaacaggagatcacgcaaagccacgtaagtgtctgattcagtcctccctggtcagttttccagcatagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctcctaggatgccatatctcagagtacgggcttcgacggggcccttcacccagctccaggaccaactgggagcctgttaggactgcaaatcctgtcctctggacctagagaatgaaagcctctgggggcaggctcagaaatctgtgtttccagattccactgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattcgtaaggaatttagcaaagaaatgtgaagacgagattgctgagttagataaaaagtggttaatgttcatcatgcctaaacttttgggggttatctgttctattagataaaaagtatttgcatctctactggacaaaagttgaccacttaagtggtgacttcacaaagtctgggatcttcaagagcaaacaatgagatgaactaagagcatgctcctaaacaacttcaggttgtccctgactgataaccaaaggatgtgccatcaaccatttgggccttgtttgcaagctttgaataatttttctggtgctttaaacacattattgttagtattttgagacggagtctcgctctttcacccaggctgaagtgcagtggcgtgatctcggctcactgcaacctccatctccagagttcaagcgattctcgtgcctcagcctcccaagtagccaggattgcaggtgcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgcctggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacatgctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatagatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagctctatatcctggggttcctgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatccggtgaacctggcagcataggtatcctctaagtttggttgtaagcccagtggggcagggcagtaaacagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttccttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtactttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcgccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcgttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagtgtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgtgttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctcttaaatctgggttttccaatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttacagggagggacagggagaaatcaggtttcttccagcccagcttctggttggaatcactcaggcagagacacatgggcctgagagaggattccccttatgacataaagccgcaaaaattctcattagtcattgcaaaaacatctatttccggcctacactgcaccagccagtgggggaggtcctgagagatagagaaaggatgaattcttgcccttagagagtcacctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaaagagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaaacaatggtaagagggcacatccttgccttgctactgatcttatcaggaaagctagtttcctaccatgaagtgtgatgttagttgtaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtcccatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccgttgcttattagctgtatgaacttgggcaagatatttaatctctctgtgcctcagttttcacatctgtaaaattatgtcaaatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctattggaacctagtcccactattcctctctcccttcattcaacactgggtttagaatgcttgccagcagcattgtggaaattacctcaaaggtagaaacacgtaactcataagcacacatgaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggaacaaaaaataacgtaaaaccataaataacagaaaagaatatatactcaaacatgtataatccatatgcatgaacataactcccctattgggaatttctcataaagaatccccccaaaatataataccacgtccacaagaacccacccacaggccaggtactgtgcgaggcactggaatacaatgggggtaacatggactaggagactcatgaaaacgtcatgacaaacacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagaggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttatcaaaaaaaaaaaactattaagttcattgaagaagtcataaaaacaaaccaaacacccaccaccttctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgtttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggctcctttgtcacaggcggctagtggttctcatgtgcagatgtaggacatccccgccatcacagagggatttgctggacaccactgagtcaaataaatggtagtatgtccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggcttgttgggagaagaagggagctggtttggagtaaatccatccccaccactatcaggtcttgcccaggcataccctgcttttcctgaatgtcctgaatgttgttgtaggacaacaaatgcgctttataattattcataggacctctcactactaatctttgagtcgataacagcttctgctatagaagggggcagatcactgggcttaaatgtcaaatagcgcctgagaggcttaaacaaccaccagtatgtgtccctctgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccaggcccggctaattttgtatttttagtatagatgggtttctccatgttgttcaggctggtcttgaactcccgacctcagataatccacacgcctcggcctcccaaaatgctgggattacaggcatgagccaccatgcccagccaccgccactcattttacacagtcccctgtatgtctcctagtgactcccctagaaattcactgaccctagccagatcccatttgtcctgtctttgtcagatttatcattctttgtctaaaaagttcaaaagcatcttgctttggccgcttcttcagacatcactctcttgtgaagatcccttgtacctggaaaactattaagatccgtatgcttttttcctgttgatctggttgtctgattcgtgtccatttggtttctaggtccagccaaagagcccacataagaaccaaggtggggttgggggtgatctctggtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttttggctccacttctgcctttgtagctgtggaccacgaggcagtgactttgaaattcagtcttattctgcggaaatattacttactcgtccctacctcatagggtggtttttcgaagtcagtgagacaaggacagtgaagggttgaggcagtgctcagcacatagtaagcgctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgatttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgaatcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggactgcagagtgctctctagtgtctctaagtgcaagaaggctgtgatgtgtctgactgagaaaatgcatgtgttagataagctttgttccagcatgagttacagtgctgctggctgtgataaattttaagtaaggcatctttaaaccgaggcgcacgtaaaacaaggttatatattgactagttgactgaactgtgaccagaggctcacaggaacctaaccctgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttatatgtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccattgtaaagttgaaaaactgttgtctagtcattctaagtcagggaatatctgtgtataaatcgtgtaaaatcctcccagaacctttatgagagggtgtggactgtgattcttaagttaatggcatccctctctgcctataacgatctcacgtctgtttttttgccaaaaaatatagctgctggggaacctgttcagggaagttgggatgtgtttatccttaggtgtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgggtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgtgtcttcagaagttatctgatgccagcttattcacatcgcctcacctcctagcagctggagcaggaatgcagcagtagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgcgaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgacgtgagtgaggaaggcgaagcagtgcacccatgatgtttggtgcagtcttgaaagcgcagtcactatggagccgccccccgcctctccccttctgagccgccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcacgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttggggcatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcctgtacattttccctttaaaagataaagagaaaccattatgcagtttttattcctgacctgcctcaaggagcagatacggactggaaagcagcccctgttggataattgctgcttgtctcagagtttgagattctgccggggtttcttgagtcaccgagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacatgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccgaggcttctctgtatttcctatcatgggtaatagtaacaatatcaataacacaatgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatacaagtctgtgcagtgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttacgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacgattacacctataccttcaatatcaaagcagatcaatttttaaaacaaatttactaacctagtcttcagatacataggtttgtttttctcactaatcctttgtggtcactgaaagagcataggccaccccagtcttttgcccagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcgcacctgagaagtgccccctgctggccagcatcatttctctgtgtctcactacagaaggaggtctttgtttatgaattctgccctccccctcttgccctgagactatcacctgctttggaaagaatggcatcatttccagaatgcccctaggggcattagcttctcttctacactctctctcttgcttttcaatatggaagttaacaacgcagtctttgaagctgggccgattggatttcaaattctaactcagtaacttcccaactgtgagtttgagcaaggtatacctcttaaggctcagtgttttaatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaacgtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgacatgatcatgactcactgccacttctacctcctgggctcaaatcttccttctgcctcagcctcctgagcagctgggaccgcaggattgcgtgccaccatgtatggctaatttttataaagttttcttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctgttgtttgtgtttttcttcccatttaagaacgtacatttgaaggtgcagtcttgaaattcttgatatggatggcagacacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatcctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattaggcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacaatgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccagtccttgttaagttgctgagactatcatgcacaaaggtatttacacagttttgttttgggtttctttgttttttgttttgttttgttttgttttgtttttttcaacggagtctcactctgtcaccaggctagagtgcagtggcgcaagctcagctcgctgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgccacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttactaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgcccgaggaacgccagctcctttgcattcccaaactttgcaagcatgtgtcatcctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacatacctgggaacctggttgttatatccatggctggggagcagggtagcagggagcaagaactgtccaacataatctagtttacctatggactttcaaaggtttgcaaagatttacctcctactaaaatggcttgtgagcatggaaggcttaaacattagcagagcaggtagaaaaataacgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacagatgtggaacaagtttttaaagaaggaaccctatctcataagattgtcaggatcattaaacatcacgagtatgagcccacaggaaaccttcagtatatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctacatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatctggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactacttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagaggaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcagcaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgctcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcaatatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttctgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctaccccttcccaaggactatttatattgaggcaaccaaatgatcaaggaagaattcgtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatctaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagatgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagaaatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatactcttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactatggaagatgagtccattatttaatcactctggccttcggtttttcagctctaaaaatgagaatattcctttcctcaatgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaaattgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggagaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccctaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacccacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgacgcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagagatataacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctcccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcatttttagtatatgtggtaggcagcttctaagtgaccccggtgatcctcacttcctggtcttcacggcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacctctttattttaagcttcttagtttgtggcaagataactaacacatacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttaggtctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgccatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactgcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggctggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttcgatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttccacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttaggtcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttcttttttttttttttttttttttttgagacagagtctcactctgtcactggggctggagtgcagtggcgtgatctcgactcactgcaacctctgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcattgtgtgtgtgtgtgtgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaagtatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggcagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtgggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagactgcatgccacatttggcccgtgagccgtagtttgttcatccctagtttaagaagaaaaaacatcttcatactaataataatatacaatattctgttggcaaaagacattttgatacttgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacatggccacccttaatgcgtgtcataactctgccttccagcaagatttcctctccactaagaaccttttagaaatggtatttaagagaatgtgcataaaacaagtcttcatggtgattatgacatttctgctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagtttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcagaggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtgtctgtgtgtctttctatgtgtaaatgtccatccccagggattaagaagtctggatttgggttaaacttaatcatttctaagaatctcaggttttcagtcctgtcctagaatttcaaaaacagtcagagaaagcaactgtgagaagatcacagcttctcatcctgttttgagtctcaccctcctctttgccctcacaaaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctggaacccgcccccccccccccccccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggcccctgtcttgttcgtctcagtgctccccagggcccacatgcagtaccttgtacacagtgcaggcaccataaatacctgttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatacttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagttctggagaactcgtacccccaggatcagctctcaaccagggatgaatacagatggaggataaatttccccactcccttgcccctttggagatgtatttgacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattggtgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaataggataatgcatgaaccatgcttagcgtgagccataacacgcaaaagcaacataatcagtatttgttaattgtaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggagagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagccgtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaaccccgtctctactaaaactaaaaaaaaaaaaaacattagccaggtgtggtggtgggtgcctgtaatcccagctacttggaaggctaagaaaggagaattggttgaacccaggagacggaggttgcggtgagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtatcaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatacatgacagagtgaccatagcactcaggggtgcagagggtgtgtggattctgatgacagattgcctgtctgattttgcagaattagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcgggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaaaatatatatatatatatatatatataaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaagtatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctaataatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacactgagatccagagacattgaggggctctcttgggctcccccaccttgtccaggggaaagtcaggactgggatccagcgtatagtcacttgctacggctattcccattatgttttgctgctgctgaaacactggaacacattctaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcaatgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacgccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattcatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaactggaacatgctctccaggcaattctatacacactggtatctaagaaccactgcgctcagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatggcagggtggtcaagagtacggactcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaacaaacaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaaagacacaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccagtgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatcttgagaccagagctacgtgcgatgctgcctaagaaaagccgcaaaggattttatttgatttttgcacacaacaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatctgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccgtcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggttcgcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaaaagagcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaatttggccacatctgcaatgtctttaccacaaaagttaatatagatgagttctagggattaggatttggtacctttggggatcattattcagcctactgtagtaggggttcatcagttagtgggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggggtatttatctaccaactccccttctattattggttgagtccctcttctgacgagtcacaggtattcccagtaagcagcctctgtagggcacaggtgagtgatgatgggattcaccgctgacagctctgctgtagatttccccgggcaggtgacctctgaactgccacctgaagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttacaaaagaggtttaacagactcacagtgctggggaggcctggcaatcatggtggaaggtgaaaggcacatctcacatggcagcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatgggggaaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagtggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtctgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctacaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggataggtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacaatcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcagtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaactcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttcccatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagacaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactccgtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctgtgagagactggaaggcacccagatgatccaaggtgatggccaaacctacaaacaggggagccagggacaagagcagggatgattgaatctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtattctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctatgggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcatgtgatgctgtttgatagcattttacccacagtagaacttctttcaaaattggagtctaccctctcaagccctgctactgctttgtcaactggtttaggtactgttttaaatcttttgttgtcatttcaacaatgttcacagtatcttcccaaggaatagaatccatctcaagaaaccactttcttggctcatctataagaagcaactcctcatctgttcaagttttatcatgagatttcagcaattcagtcacatcttcaggctctatttctaattatagttgtctttcagtttccaccacatctgccgttacttcctctactgaagtcataaagccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttagacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctgtggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggccggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattacgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctattatttatgtatggtgaaatctatataatggggaacagctgctcatagctgccagcacttcattcagtgaagtcacattggcagcttgaagctggccatgccgggagtatttatatgacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacatattctttaaacatctgaaaagtattttgggattcagcaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttgatctgcagcttaaatgtgacttcttcaaaaaagacttctttgatcccttcagtaccaaatgagttcttccctttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctgtcactcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctcttattcttgctcaagaaatgagtggccagttgctaccagcctatcccaaaagccaagagataaaagccagcagcagttaattttctagtccgtgtgctagtgaccacagatatctaaccactgatttccaaaggcttactattattcatacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctccagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgccttgatggcacttacttcttagggaaaagagaggatgacagaactgtagagaaaacagagtataccagatagcaatgagggctgtggagaaaataaggtgggaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgtagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggtctgtccctgcagtgactgtgctattcatagcaagaatgttgtgttgctaaacttggcatgaaacaatacagttatttatgcgacttcatgaactagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatagaatctaatgggctttgcttacaatgtgcatggcttggctatttacatgagattgacagcacgagaaaaaccagacgctatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacacaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctatgccttctccatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacgtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttgactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacctacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacctgaaatctctctcattctcacccattcacctttcaaatctgtgcttttagcacatcacctttctgccctaaaacgtttagtggctcacaagctagtttccaaattccttagcttagtagttagccctccgctaccttttcttaatgcacttttacacttttctccatgctgtaactaaacagcactacctactaaaatagaaagatacctttcaggttcctgacctcatgccagtatctaccatttccttttcctagaattctctctttctccttatttaaatcctgtgcattctctagtgcatttgggggaaaatgtcatctctttctgtaggcattaactctctatgccctaaaatttcatataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccctttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatccctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaacaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccacggcacctggctaatttttgcatttttttgtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgcttgtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagataggatggcagcctctgccagcatgtttcaggatatacccaggaagcaaatacctggttggaataacaaagtccaaagcgaagcaagagggtgattgttaaatgagtaattagaataaacactgaaaaatggtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctctgggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatatgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggcgcctgtaaccccagctactcaggaggctgaggcaggagaatcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagaactaagattaccaagtcactaatatttttgtggttcttaatggatatatattgccaactgcttttcaaaactattgttatatttaataccatcaaaatatatccattcacaagtttaattacactgtcttcatcattagtcataacgttttaaaaacataattgccagcataagagggaatctatctatgtctttctatttctctctctctatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaaacctgagatgcttttatcattgaaagtagaaggtgtccccattactggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgatttcttaaaatttttacttgaaaaaaatttcagcttataaagaagttgcaagagtcgtaccatagttggaaatactctgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagcatacctgggacctggttagaaattcataatctgtagccaaaacctatggaattggaatctacaattagaagaccctcaggagtatgcacgttaaagtttgaggtgtttaaagttaaagtatgcactttaaagtttgaggtgtgtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcctcaggtccgaatcagaaactttggagaatggcactactgtttaacgagaccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattccagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcagcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggttgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagagctggggtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccggtctcagcgattgatctagacacatttatgaccaatatatggcaaatgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgcagagagaaagagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgagtaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcctgagcatctatccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagcccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaaaacaggtaaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaactaatagtggatttctccggactgttaacttctgttcaaagagcccgccaatgatggatagagagcggcgtgcagaaaggaatctttccctggttcagcttgggtgcactgccttgtgctgactctgtcccctcccctacccaccacaccccatgtgtctagaacaatctcctctgcagtacttcatttcctaaatgaattagtccagagccctgttttgaacagatgcctgtacagttcttgattggttgaggcaagtctaaactgacataagccctaactctgaaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcgttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctcttccccttaacccctaactgggggctttctaccctgtctttgcacaccatttatcctctctataatgacaactcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggccctttattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaacttagtgtacagtaactctaatgcctgatatttgatttgcattaagcactgacaagaacctttcatgtctatttctgccctggggtcctaaaacataaattttaacattccttgcttctccttgatgatcattcccacatagaaatggaactgcattaataatgattgttgaaaaaatgaataaatgattgttgaatgaataaccgaatgaatgccaccagggaaaattattgtctccatttcattttagggcctgaactttaggagaataaagttatcctaaagagagctgttggaacctgcctttctaaccagcttcctattttctagaaaaggggtcactgtttgtaggaattgtctaggattcctgagaactgccatcaaacattcattttgcttttcctattgctaagcattatcagacagagacacagcttctacacaaaggaagatggtagggcattgtctgttcagggctgctagatcaatattatagttttatttatctattaatttatttggatttctaagcagctctaccttttgttacgatgattatatggcaaaatgcaaaacaacttgacaggactttgctatctagacttttgataatgatctctaaaagccaactcatttcatttgcgtccttttatgaataatacaaaaaaatccaaaccttaactagtgtttgtcacagtcagtgggtacttcatgagccaagagtgcatagaaaggtatttttggttcattactaggtttctataattgacctgacattttgtgagagcaatcatgtttgttaaggagaaactcaagccaatgctgtagttgcaaagttctccttactattaccctgggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacatttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaaccatattttgtcaaattggttatttctgatgatgtatccccaattttctgaaatgttttaaaacttacattgtagctttctctcatttccttattcctatgttctcattctggtccatcatctgttcatttattcagtccattctttgtgtattcattcaattattctttcaagtgacatttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaatgtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggaaagaagtcatgagtcattagtctggactgctatagtaatgataataatagtaagaataataatagccaccatttgtggatcacttactgcaaaccaggaactgtgttaaatccttctcatgtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctcttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcctatctactctcctgtttgtctcttgctgcagactcctctaaggcagggaccacttttcaccacctttccatgcccctggatccttgttcagatttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttcatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccccctttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttcccctgttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgcaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttttttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttttgaattgtcatgcagctcagaactgggggatctagaaactgaattcagcagctgattatttggttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcaggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtagtttatggatgtgtcagaacaaactgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctattatgcatctggtgtaaagcctcctcatctttagctcaattcaacaagtttccattcagtgcccagctctaaaagtcttaaatggaaattgattccctactccttctattttaactgtcaaaatcatagactgcattgtttccaactgaaaatccgctgacagctccccaccaaccaccccgtgagccttcctagggctggcgttgatgatgctgctatcaatggggaatctacattgtgcacgggtatttatgatgagaaaatcatgtggcataaaagagaataattgccttcataagtgtataattttttatactataagcttctcaatgaaaaagcattctaagggaggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtaagttcttggatattggtttcttcttataatgacttgagaattacatggaattatccccattatatgagaagacagagtctcacaggagttaaatcacttctcataaaatcatctctcatagttatgtgagttcagaatgcacgtctatgctaccccaaagtccaagcttaatagagaaatctacagcaactctttatattctggagaggttttattactaagcttaagaattgaggtgccctaagaacgggctgcccccaaaatattttcctcaccacctcacttctgtttccagaagcccaacatgaaaatcactcttctgaaataagtcctggagtcttctttaggcttctgctaaaaagtcttattcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattgaatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttggaacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctcggtgcaaaatatgagatgtcctttgactatataatataaaatatactataacatataatattgaccttatattgaagatgtatttgtacccgacatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgttgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacctgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatagggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctctgtctttatggaggccacgttgaacctctaattctggagaatggtaacattgaagaggacattagtggccattgacgtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtgacaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtccccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacgtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttggagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctcccgagtagctgggactaaaagcgcacactgccatgcccggctaatgttttgtattttagtagagatggggtttcaccacattgcccaggctggtcttgaactactaagctctgagctcaggcaatccccccgcttcggcctcccaaagtgctaggattacagccgtgagccaacacacctggcccaatagttccaattttttatgtgtatatttttaaaaaattaagttgtgactttagcgtgaattgaaatttgtttgactatacttcataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtaccattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgcttccccagaagaaggtcctgggatgagaatttgtgttaaagtgatgtatcggaaaggttgctaggaaaaacgtatagggaagtgggaactgagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccatggaaattggccaacattacaaattagggctcccttccctccacccagaagtgttcagtaaatatttactggcatactaccggagctgctggcctttgggaatggaagcatactgggggtccgtgtgcactaaaatggcaaagaaaatctaggggatgtggatggtgcagggacagcatctactgcagcactcatgtataccagctgcaatatggtaggaaacctgcccctgcccacacaggctaggcagaggtgtgtgagaaaaagggaactggtgagagggaggggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactctaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcgcacgagagcccagaatcagtagctgggcctcctggtgtggaaaggatagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgtggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttctttttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcatttttttttttttttcatttctacatggcttggtttccccatctgtaaattgtggatacttacactagctatctcataggttattgtgagaaataagtgagtctgtatgtatgaagcccatagaaatatacataacatagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcttacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagaggttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggacatatccttttcctattctgaaactctactctgcttaggatgcatactgatggctctttttttgtgaatggatggaagtatgaaaggagcagtaagaaagggcactatcaggctgcatgcagtggctcacatctggaatcccagcactttggaaagctgaggccagcagatcacttgaggccaggagttcaagaccagtctggccaatgtggcaaaacactctctctcctaaaaatacaaaaattagctgaggacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgcctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtgtttcatttgtgataattttaaatacaagtgttggtctgaagaaaggaaatgatcaggaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgtagggaagttgagggacatgtccaagatcacacagatagtaggcagtccagcttcagaatctgtggtctctaccagtgcactttgccacttcacagaactatccagccagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggagcgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatagtctcattgcagagacttctgctcccttgttgcttgtaggaatgggggtggggaaaggtcaggactatatatttaagaaaaaaaccccacatatgtcgacccacaagtggttacaacaacattggtttacttgaaagctctgtctccactctccctacaaaaattcaagtaagaacctggaatgcaaggaggtggaagagttttctctccttgccaatctctcccttgctctctgataaaaggtgcggcaaacagggtagaaatgactgcacgggaccagaggatgtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgcctaccgttctgcttgctggtggttcaggttttgtgaacttatacaagggcttggtatttgaatgctatcttaatgagaataagcttttttgttgtgtacattggcaacttgatggctaaggtcattctccatccatttgtctagctacccacacacctatacatccatctacccatctgtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagctgatgaatattcagacttgaagttcctcctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaaattgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgatctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacccggagaaaatggtgattagaatctctgcaccagtttctgtgatttttttgagacatcctgaagatgagaggtgagtagacagcagatgggcagggccagcatggtttttgtctggttatttatttctgtggaataagttcctagaaataggatgtctctctgggtcaaaaggtatgtacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctggcttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccaatggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggctcaggatctgacatctttgggacccattatcagtctactaactatgttattaaatatagcttgcaaatatgttgtcgaggattttgtttttatattcctgagagatattggtctttttttctttagatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggtgatctgtgtcttctctcttttatcttggttagtttaggtaagatttgtcaattttgttgacattttcaaagagcaaatttttggtcttattgattttctctgatgcatttgtaccttttttgtgtacttcaaagaagccattggcaaattaaatatgactggacaacttttcacataagtaactaggaaaggtaaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccttgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacttgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagtgagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaaaaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttctgcactgccgcttgttacttggagccattacttcctatctgtgttgtcaatcgtgtcttgaggttattctagcaccttacgaaaagccaccatccacctaattttagagcttttaagataaagcccgggagcactaggaaggtgagtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattgctagctctcgcaccctctctgcccttgacctcaataatataccatatcttgattcactggctccaggtctcctaccaccgaggacttgccttactttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagatctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggtacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccacgtggctgcttgggcttcctcacaggatggtaggtggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtattgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggatactatcatccttactcaatatctgccaatcctttgggcaacatagaatattctactgttgttttcatttgcatttctcttaagaccttatctggagaattatgttttttcaacataaataaataagaattgtccaaggtaagagttgtgtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaactgaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttactctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgggcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttcttgaagtaactttatggtttgtatacggatgccaaatatagatacatatctaatttatctattttatttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttcgacttgtggctttgtcatttccccacaggggcagcttccgctggttttacaggacagaaaagttctgtttctattactgaagaggttgaaccctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtttagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccacatggtcccacctacaacatgtgggaattatgggagctacaattcaagatgagatttgggtgaggacacagccaaaccatatcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttgaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgattctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcatgggctggcagcgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagacggagctgccatcttgaacatgtctagtccttagttcctgccagcattcacctgtgcaagtctccagcttgcttgtctatgtctgcagctcaactttacattttctttgttagaaaattatttggggttgctttttattaaaaagaaaagccttaccaaggattcccatgcccttaccatctgcctgtgtaatttcttcttaactcctgtatcatcaggaacgtgaaccctattgtgaattgtacatgccagggatctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtggtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaaacaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcaatctttaaatgaagctattttttctttgtctctctgtccctctgtgtctctctctgtgtctcacacacatacacatgcacacacacacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagtcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaaggtgaagaggagcaaaatcgtgtctcatgtggcagcagacaggagagaatgagaaccaaatgaaaggggtttccccttataaaaccatcagatttcatgagacttattcactaccatgagaacagtatgggggaaagtgcccccatgattcaattatttcccaccaggtccctcccacaacgtgtgggaattattaattcaagatgagatttgggttggggacgcagccaaaccatatcagtaggtcaaatgcaaagcctgaaatatggagaggaagacatcagtataaatcctggttccgtcacttgaatacgttgccttgagcaaattattcccttgcagaatctcagtttttccacctgtaaaatggagacggcaaaaattaacagtcacctcggggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacaacaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaattttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctctaagatcagcttctgcttatttcgttgttttgcttcatcatctttacattgcacaatccacgtgtagaaaatagcccttccctttcctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgctgccgcaaaatgtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagcggatgtgccatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtcaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaacctaagcatccaatagtgaaagtttatatgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgatgcaatatctgtggataaaaccaccagcccctatcaagtcaatcaaatatttactgagcacttattatgtccaagacactttggagaacaaagaaatataacctggccttgcccttcaggctgtatcaattgagatagaatttggactgctgcaatcaattacacagatgtctctcaaggtagtgtcttgatgcttgagggaaacaagacaaaatgctattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatagccctttatcagctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttggttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgttaacatcctacaatatacaggactgcctatcatagcagaattatctggcccaaaatttcagcagtaccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctcttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggcgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagcttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcagttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgctgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaaatatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattcggcctcaccttttttaggttctggcagccccaggtgttccttggcttgtagctgaatcactgcaatctctgctttgttcctcacacagtgttctccctgcgtctctgtcttcacatggcattttcttatatggaccccacgcatactggaataggtccactctaacggcttcctcttaactcgatgacatgtgcacagattctattcccaaataaggtcacttttgcagattccaggggttaggagttggacgtttcttttagggggacacaattcaacccctaaatggggatctcctgacagttcttaatagggtcaatatttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggcgaggacagtgaaacccacagcagtgagagagttgtatgcacatggacacaaaagagcatctgatcataaagagaaggaaaccaaacctgtctgggcactgcaatgtgtgaatctagaactctccaactgctatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacgtgactccttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatagtccctggttaatagtaagctttcaatgagtgttggctagcattcatgcccgtaagttatcctcttgcctagagcagtgatggctctaatgtgagttcagatccctacaataggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctctttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcaccagtgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttgactgaaatgatattagctctgcatggtgaacttagtaatttaattctgatcagcagctctggttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctgcatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagctgctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacaagaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaactttagaatattttttaaatctcctggaaaaaaaaaaaaacactatcctgagtcatacctcattttccaccattatatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcctaaaacattcaagaaggatgttatcggtacatgatcagagttgagtaggttctggattttaatgcctgtacttgctttttacttataaatgattaatactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacagatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataaagagacaaagaatgccttaggtgtttcctctacctagcataatcaaatactactatgaaatatgcaagagtctgtgtcatcactgacattcagtcttggatttattttttttaactctgtgtactagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcctgcaaccttttattcctaattctagtctttaatatctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagctgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaatagaagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatatctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccaaggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagtaaatttccccttttatttggaaagcctctactttacaattcatgtttaccttcctgaatcttttctacatttcaaattcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagcaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgagaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttattttttaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaatatgcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacgtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatgcatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtgggacttcccaccacaagtcaatgaggagatggggtagccaggcctaaaaccccggcctttggcttacagccgcccgtcattttcccaggtgcccacctcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcaattgaacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacaacctccaccacaaagaattatctggccccaaacatcgatagtgccaaggtggagaaaccctaggcttatggatgccatgggaaacaccagttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagcgtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaaggtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatcactgagatctcataaatccataatgggcctgctctgtattaataaaacaatctcaatggtggagctccataaaagagaggcataggctgatgtaatttccttgaagtcccctgtaaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcagtctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttaatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctaagtgattactctgtatgtgttagtgaaatgcattaagtgcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacagtgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccaacttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattcaagtatcctagcacgtcaacttttattgcttcacttaaaatctgccaccttccaccttcatgtcctgaatcctttatctagaaaatgtgtaattttccaagaaggcctcagacctagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaaccctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattctttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagtgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtgctccacctatatcctttccttttaccattctggggcatactggcctaatttacttgcagaagaacaaacacattctgagaacagccaggcctcaaccaaagaccagcaggagcaggtgcataaataccccaactccctcacccttcgaatgcgatgactctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccattattgctgggccctgccataagcttatttgtatttcacagcgacttgcacagatgtgccagatatgtacagatggatttttatcagaagagagtctacccaagtgaagcagtgtagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgattcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaaacagtgtgcaagaatcctgttaaagacctgccctcactgaactgtgcccctccacctggaggctgcagcgggtcaaggatggcttcactgaagggatgatatttgaacaagacttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcccaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttggcttatatttgcccagaaatggaatttctggatcacaggtatgacaggcagaataatgaccccaatgatatccacattctaatacctagaaactgcaaatatgtgaccttgggtggcaaaagggactttgcagatgtaattagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcgctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttgacaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgtagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagcagtgcagaagggaaatatggggttggagcccccacacagagtccccactggggcactgcttagtggagctgtgagaagagggtcaccatcctccataccccaaaatggtagctccaccgacagcttgcaccaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcgtctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggactgcatacatacaaatacccattctaggtggtttccaaaaggactccatttctatgggaatattttccattgagctgtttatgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagccctctccttgaccccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccatatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccatttcccagtatttattgagggatgaagagtctttctgtcaactttcagtgagaagaagtaaataaaacagctttgatggatacccccatgaaccggagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctatggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttcgtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcaggggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaaatattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaaaaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgagttaagtctatggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcattgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcagtttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagaatgaagactgaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattctagaattcagcattttcaaagttcatctttgaaatggatagcctcttgttctgcagaaaagcaaggatcctagaaaaaacatgcaaactgcatttcaaggaggatggcatcatctttttgtttctcttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttactgctgaaaggcaaatttaaggtaaaaatcaaatactttaaaagtatatatcttaatatgccttcctcttaacattcatctagtaaggggggagatgtagaattttgatataaattggccagccttatgttgatttatctttaacacagatttcaactccttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccattaaatggagattttgatatatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatgtttgtatgatcaataaattggtctgatttaaaattagcctataaagacattttttaaaagcaaatgcttaacttcaatactacatgacaagagggtgatatacaaaaaaaagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggatatcttagaaaatcataatgagagtgatgatgatgatgatggtagtgatgatgattatggtaatgataactatagtgatggtgatgacgatggtgatggtgggggtaatggtgatggtgatggtggtgatgatgatagtgatggtgatggtggtgatagtaatgattacggtggtggtgatgatgattctagtgatggtgatgctgatggcggtgatggtgatgttgattattatggtaatgataattacgatggtgttgttgatgatggtggtggtggtggtaatgatgatggtgatggtggtgatgatgatgatagtgatggtgatggtgatgatggtgatggtggtgatgatgatgatgatgatagtgatggtgatggtggtgatggtaatgacggtggtgatgatggtgatggtagtggtggtgatgctgatggtggtgatggtggtgatgatggtgatgatggtgatgatagtgatggtgatgatggtggtgatgttgatggtagtgatgatgataatgatggtaatgggtggtaaagatgataatgccttactctaggctagatattgtgctaaatatttcactgacaagcaaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttctataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctgggctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggtcaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactccttaatgttactagcatttaagttgtttttttcccccctcctttgtcagtcccaaagctcctatggctcaactgttggtgcacataaccttagggaggtgatttgaagaaattttaccgaaatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcaggttatatttgtccttttcctcaattgttcctacctacctaccgacttacttggctattttcattcatcattaagtgattgatggatcatagttgctaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacgtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcatttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccactgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccaggctgggcaacaagagcaaaactctgtctcaaaaaaaaaaaaaaaaaaaaaaaaaaacaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcggggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtggaacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttcagctcatggaaagggctgaataaatattaaatataaaccagacctcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctattttactctcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttcctttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactcctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggagacaactcttagagcccaaatcgataaaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaatatatatatatatatatatatatatatatatgtatatatatatatttgtatatatatatgtatatatatttgtatatatatatttgtatatatatttgtatatatatatttgtatatatatatgtatatatatatgtttgtgtatatatatatgtatatttacatttactactacacagttggtaattaatgaaacggaaaacctcagtgttcagcaatagggaactgctttaatgagagcagatagatccatactaagagataatatgcagtcataaaaaagcaatctatataaactgatgtaaaaagtatttaatagctattaagagaaaacctacctactgaactgtttaagtgtatatatagcttgcaaatttggtagaataatttaataatcaaaatgtgtggctaatcggggaagtcagggcttgttgagatagtaacaggctgcatctcctatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtatgtatatatatatatatatatatatatatatatatatatatatatataaagaaaaagcacgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctggaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtattatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtcataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaaggaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaacacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttataacacgcatggagccatctcctatgatatcaatgccttcttctggatacctcctgaaggacttgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaacaataaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcactctgacgttatgacagctacctcactaggcaataggactttttcagctccgttatcatcttacgggattgctatcatatatgtgttcctctgtagatcagaacatcgctatgtggcacatgaccgaatttggacaaatgtgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgctgctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaagtttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgatatcttctgctgacatgatagaattgaaactctattttatcaaagttggaactgaagcatggaatggaattaagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcttatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagtggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaatctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatctgatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcaacaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccattctcatgctactaataaagacatacctgggacagggtaatttataaagaaaagaggtgtaattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccgcaactcagcacagttgtatcataatcttgggagagagtgggggcaggtattgctattctttttaatgctccttcagcatttcttagatggccagccttgagaaagaaccatggcctaaagcacctactcctgagttggtaagtggtatcaaaaatatacaaagacccaattatgcaactgttagctatttgatttagaaagtattgagtgccggtgatgtgccaggtcctgaaactgcagttgttctcagtgtgacctcacttggtacctctgatgatcccaaaggggtttgtgagatgcccaagggggccatgttggggcaactgtcctttctccacttgcccatctattcctaggaagcagatgtgcccagagcttgggctgtagaggcagaatgaacagatcagagaaggttctcgctctaggcctttctggatatgggaccacgagctagtcagtcaatctctctgagactcagtctcttctcctgtaaaatataatatgatgcttatatatttatagactgtgcattctcattggggctatatttcccccacaggggtgaaataggttcgagggtggggggacaaaaattgcacttacaaatgtaaagtatagatatacttgtagtacctaaacagatataagtatatctgtgatattaaaattttacaggaatagtggcaattagaaaaaaatacttaaaagagcccttaggggagtagataatgaaaaaaacaaaagttaagcaaccctgctatagaattgctatgaggctgaaaggaggtatggacttgtacagtcctttgcatagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagaccccccccccccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagctatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttcggtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaagaaagttcctagcaacaatatttggagccccaaagtggaaatagtccagataccagtcgagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataatgtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttactaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcgtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacatgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtgtgcacactcagagcttagcacctgcctggaacatgcgagttcgtcaaggacatgtcttgattgagtgaagtccatcagcacaaagtcacttgggcacaggcatcttgctgtgggataaaacgtaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggctaagattccttttgttattgttgttgcaaatgacagaaatccaactctaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggatagaccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatatatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacggtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacaggcacatgcatgcagatccctgcactcccacacatatgcatacactttataagtgtcacaaactgccattcaggcttcccgattgtgccattcggagactttttgctactactgactcctgccttcttcaccaggagctcagggactccaccttcgtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattagccacatccctgcttgatctactcattttgttcagtggtggagcgagtgtgggtcacacagctgggagcagagacagtacaactggcaatgtgagagttaccttcccgccagtgctgtctgtgtgatcttgagagcatcatatagcttctttatctgcagaatagcgaggttaaacagcctgcagtggcaaataagtggctcatgtgccaccctactgtcaccgtgctcgtggcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacgaatgtacggcacgtcagtcatgtttcagaggaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctactgggtgaggagactgagacacaatggggctgtttcttgctctggacacttagctagtaggtggcggaagagggcctcagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacacaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagagatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaagtaaaaacaccatacttactctttctttctgagttaagaacttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaatccagacctatgataaatgttcagctaatgaacgaggcaaactgaggtgacccagtcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcactgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaagtggagaaaatatatagcttgaaaattattgtacggatccaagaattgggcctagaattcaataataggctgttacatcttgacacatgcctaaattgttatgtttatgtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtgtatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcgtggagttggttgagtggcagccagtgcggccatccacaggctttcccaagtgcatcgctgcagccatagttagctccccagcagctgctcggggctttcacatagatggaatatagtgttgtcagaggtaaatttccagctagtatataggatagaacaagataatgtaataaaatgtacattttctaggctctctgatatgcttctaccctcctatctcttgttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcatctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggatagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctccaaccttgttacaaacaattcagaagggaggattgtgaaatccttcctgctgctctttctgtcttctgccaatcagagaagactggacatgagatccaagagagggctttccctttccccgatggctacactgtgtctcctgcctcccagctgtttatggaaatcagatggtttcctcaactgtctatctttctgcagcaaatcctttgacagagaatgtgcactgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggaggataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacgctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatcttcccaggcgaaaccaaattatttctccttcaaatcgctgcctcccttccccagtcttgttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacataaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggcctctttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagagaccgggtttcaccgtgttagccaggatggtgtcaatctcctgacctcgtgatccgcctgcctcagcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttatgagttacataatttacaatgattgagtgtgggcagctctattatctggatttcattaagatgatgctacaaaaatagtaattgttagtaataataatgctacaaaaacgttgtatacttgcaagatttacaaattacataatttatgatgattgaatgggggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactctagttataacttgcttttgggtttatacctaggagtggaattgctggctcaaatgataattctatgttcaactctttgagaaaccacccaactgtcccctaggagtggaattgctggctcatatgataattctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatattttcttcctctagttcttcttcttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccatcgtgtctacagcgcatctccacccgtacatttcacttgcctctcggggttaactgtgtgtttctgaacgctcatactggggttaactgtgtgagtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccaaagaataactgtgatcatatcatgccctcttcaaaggctgtcagtcttcccatgcttactgagccacaacgaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggtttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaattttttttttgttgttaactttgtccttgttaacattaattctctcatgtcatgtggaaatgagaataattcagatattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactttatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaataggttgtacagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcatgtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctatatgtcttcattttcagacaacctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatagaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtattgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctattacaggacatttatctaggacatgttaacaactcctacaaaaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacacgctctcttgcctgctgccgtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgaaggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactggggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttcctatgtttcaacatgggggtaccaaataattcatttccccttttcccaacagatgcattcttgtgacctcactgatgacaggggcgtcgtttattctaacaaatgctcttgtccaaattccaaccatgttgccaagagatggcatagctggtgagggctggactttaggggccaatctccactcctgagctcccctgaccacacaggaagaaaacattaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacccggcctacttttacgtctcataacccaaaagctctatggcttcaaaaattcccaactcctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcgtaggtctccattcttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaaagcaggtaataactgtcttattctgtacctattgtctgttttcacagtctgctgtgaacccttgctttcagctgggacactgttgccttccactgccttccacagcctctttacttccccttaaacaacctattccaactggtactacttgataatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggactaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcatctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggtgaccttctccctgtgccaaccccggaatacaatgggatgagtaactggcaggtccagatacagaaaatgagtgagcaatgcctttcccagctaaaaattcttccagctcacccatggtgtgctagggaagatgttctcctatgtcctgaatgaccagcagcagaggattcagggcacccaatgcaaaattgtcaccaaatgactgtgacactgaagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggaataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaaccccgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatacgatagtgacagcttaaagattcttctaaaactagatatgaaatttgaatgtggcacctgtctataatttgtaaagcactttggctttttctcagctacatggtgatgatgagttcttctcaacaagtgactaagctctaggggaatcagtttctcaatttgcatgagatacgggagcttcctaagacatgagactttcagttttaaaaccaggatagtcttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccaatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgaccgttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttcgccacctgctctggccaaaaagtttgaaggaggacctatgaaaaatatccctggcctgggcttaagaagccttcaccctcattctcaactctgaggctaccagagcatgatcagttcatcatctcagtcaatcctcccagctcctctattagatccatatgactgccactttgtgaaagatacaaggaggacttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgacgttcagggtttggcgaatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgcaagttcatggagtgcaagggctgtggacaccctgcttgccaatttttctgccttaaccgttccctgcccccttgttgttcaatttctggccaatgtctaaattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgctgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtgccttctggccataagtaccaaggaattcataaagttggattaaatgataacaaaaattggaactttccctttatcttcttttcttcttaaagaataagttaagatacattgatttcatttcacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacattgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacaacacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctgtgctcctgactaccatgtagctcttccctgagagctcctccaagccttggttaaagggccagaccctttgctctctgagcaggaggagagcaacgtctgccctcactgacccattaatagacacctgtcagtgaggaagggaggcttgttcacttcagggagctgtggtcgcttcccctgtgccactggaaaactaataattcatgaagttggctttcaggtacgagcaagctggactgaatagttgtttcaagtcataaacatagaaaagtaagttgataggagaagactatgtggagaaaatttaaccatgttaaatatttgaataaacatttaaaaatacatagcatatataggtgcatatataataaatttgagacagtaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttggtacttagtttctgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggagcaatgtcgttatgagaattccccacattttgctcccttttggacctccctaaaattcccctaagaacacccctcactagtagaaatgtagaatcccagaccttaccccagatctactgaatcagagtctgtatttttaacaagatcccctacattggaggaaagttgtagaaagactgccctggaggatttctaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgtggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcgaggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaccctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgatgcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttattaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgtttggtcccaattcgctgagactaggaattcaaacccaggaaaattgagacacctgtgtatgaaaagcataaagagaaaatttggttgccctcatgctcactcttatgccaagtatttattcaagaattaaatgaataagaatagggatttcaactacgttctatcctcctcctcctcctgcatctgcctgaccttcttgggagccagatgttccactgaacactttgcatgcactgtgactatctaatgcaatccttgggacagatctgtgaaatagagtctgttattagtcccgttttaaagatgaggacactaagattcagatggtttaagtaacctgtccagtgtccacagctcctgtattagctgagagtcttgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcaggctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctactagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaaagagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatcctcctgcctcaggctcccaaattgctgggattacaggcatgcgccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaataaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaacggtgtcttccctttcaagagacttttctagtaagaattttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacacaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttactcttagcagctcactagttgtttaacatacctaatattaaccatctggtcagggagctaaatacaatgaagggcatccagctattatcccacccatttgcctatcccaagttatgttttattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggatgttataggtagcgctcttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtattcatcttctctttgtggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaataggttgagtaagtagaggtgtttttcttgcctaacgagaagtctcagtgtaggtgatgctgggtttggttcaactattcaacagtgctatgagaaattcaggctattcctctacttcatctcagcatccttaattgtctggctttaatcttcatagttttccccttatattggtctgttttcatgctgttgatagagacatagctgagactgggaagaaaaagaggtttaattggacttacagttccacatggctggggaggccctagaatcatgacagggggcaaaaggcacttctttcttggtggcggcaagggaacatgagaaagaagcaaaagcagaaacccctgataaacccatcagatgtcttgagatttattcactatcatgagaatagcacaggaaagaccagcccccaggattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatgcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaattcagaagtgttctgaatggcgtcatgaaatactatgttagtgccagctcacatcctttgctgagagagttaaacgtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgcagtatttcaattccagatctaccatttataagctgtgtgtttttgggtaaggtactctgagacttagtgttctaatctgtaaaaggggataattccttccactggagttctaattaagactcattagggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaaccgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcagttgtttatgccatgtaggaaactgatcaatgacttaatttgacgtgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccagctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctgttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcactttggaataggcctcatgcttgggactgcctccgtcagtgtgcagccttcagcggctacatttggaaatggtacaagtattaggttggcgcaaaaagtagttgcggttttgccactgaaagtaatggcaaatacttagaaatatttagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgagtttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcattaatatatgatcaatagattttttttggtacaagggcagaattgagtagttgcaatacaaacagtgtggattacaatgcctaaaatatttactacctggttctttatagacaaaatttacagactcctgaggcagggttttatcaattcctttccatgtctatggatttagatataagcgtatattttgttaaatattacagcagactttgaggtggctatcatctccattttacagatgtagaggatcaggctcacaggtagtgaatggcagaaccaaggatgaattccagcccactaacgtcacatctctatttgatcattagcgtatagacttttggtccttcataaattttactttataaagatattttacgttgtataattgatgtcatggccatattgtttaatcatcactcaccatgcacctattgtgtggcaggcactattctatccattagggcacaatagtgaacgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcatacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgaatgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccgaccaatatggtgagaccctgtctctactaaaaatacaaaaatgagttgggcatggtggtgcacccctgtaatcccagccacttgggaggctgaggcgggagaatcgcttgaacccaggaggcagaggttgcagtgagtcgagatcgcgtcattgcactccagactgggcgacaaagcgaaactgcatctcaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggcatatttttcccattcaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaagaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccaggttttcccaaatacacctattattaccccaaagagtaggaagccgatcttatctagattcactcaccaaatctagaatctcccaagagactccaaatttagtacattaatttttcttaagtataacattgctcagtaactatgtgggtgaagatctgaaagttctgcagcactgtttcatttataaaaataaaggtaacggtacttttgcgcaagatttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttttttttgaggtggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaactcctgacctcaggtgatccacctacctcggcctcccaaagtgctgggattacaggcatgaaccactgctcccagcccaccataagtactttaatatgctaatttatttcaaacaatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattactcagcaattaatcctcattgttgtaacaaatagttacaaaattctcgttgcatggctctggcttaactgcaaagcaaagtagaaaatggagaagctcccaggcaaggccaacaacgcctggtctgtgctgcacgtgaagatatctgagcacttgtgacccctgctttgccctctttgtcattgcaatggggttactgggaaagcctctcccatggtggttgacaagagggaaactttgggaaatgttctcaggagtaacccacattattttcacgcctgaaagatgcaaggttggatagagagagaagttgggctgtggtacgcttacaacagagatctcaactgaccctgcagagagctttaagatgaggagaacccttctgtgttgtccttactcaggacaaggagctgaggtcttatgcctccacattgactagtcattgaatgtaggctcatttcaggaagggagtataatcttgggagaggtgctgtcttcagcagaaggcaaggcctcttagtttatagctgtcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatgggatgaatcatacctatcctcaccctgcttttggacactggtatatcctctcaaaggcattaataactatgttataatgcaaatatcacgttatctttctatgatttttctaacccaatagactgtgagttcttcaagcttatgtatttgggtacagaacacctcgccaaaatccttggcatatggtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatgtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcgctttccagtcgtgtgtcaatgcaaagtgagcggatttgggtttaactcccttggactgagtgcaattatatgttgggaggggactaacaaggtagcccatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatattgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgtatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatataacactagtcttctatttttatttttaaataaaactttgtaattggtaaagtcacagaatcagtgtgcatatgatcaaagtctataaaataatgaaccatgcataattgcagcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgtgttaaataatattatagcatttcatatatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtgggtgtgtatgtatacatacacatatacatatatatgcacatacacacccacacacacatacataaagatagtgttcatacatataagatctaacttctaagatatataagatcctattctaacatatttaatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccgggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagcactcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataacctattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcagggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagttcatggtaaaggacaaaaattatttgtcaaatattgattgagcacctactatatgccagacactggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcatgtcatcccagctactgaggaggctgaggaaggataatcaattgaacctgggaggcagaggttgcagtaagccgagatcgtgcccctgcactccagcctgggagagagagtgagatttcatctcaataaggaaatagtgggtagagtggccaggacagggctcatggagtaggtgacttgtgaggaaaggtctgaggaaagtgaaagaactgctgtggaagacagaaccaaggccccaggattgttcacattctactccttggaacctgtgaatgtgttaccttatatggccaaatagactttgcaaatgtgattcaagttaaggattttggattatgttgatgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctggtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggagcaaggtggtgggaattggataagggtaagagggtaagaaatagttatattgtgaatgtattttgaagatggaggtcattaaccagaaaagggtaaatgtgatacatgtaggctgaactggaagagacagtgaataaaattcctttgctaattaaactttcttttttttttttctttttctttttttttttctttttcttttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagcggaatggcctgtgttcaaatgctggcttctctaacttaccagaattacgtatgtccttgagcagagtgtttaaccttcctgtgcctcactttcctcatctgtagtatgggatacatcacagaaattgtgtatcaaagggggaaaatgtttgcaagacttagtgcctaattcacagtaagtgctcaaaaaatgcacacagtaagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatctggggcctgctttccccaggatcaccgtaagattctacctgaggagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaaattgatagaaaccacccccaaatcatcatctaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccacagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagttattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacgtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaacgggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaactgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttcccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggttgttgcaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataatatcattggatagtgccatgatagaagaatgtcccatgtgcagtgagaatctagagagaaaataagtgattacacttaaagtagagagtcagggaagacttcctgggagaggtgacatttagactaaagcataaataatattgatttgtttgccaaatggaggaagcaaagaaggatcctgagtgaaagcatgatgtgtctgaggatttgcaagtcgatcatgaggttgcagcatacatcacatgggagagagttgctgactcttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcgtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggctttgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagtaaaatatctgtacctttttctttagcatcgaggtatctatttaccagaccttcgtgagcaccgtgcagtttattttttaaaaatatttctcaactttatagtcagtatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaaggaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgacgacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcagctgagaagcagagccaggaggacagtgatagcacttgaggtcagagtggtcatcgggatccaagcctgctggatcttcctggccttaggaaacccagaggcttcatcctttggcaaggggaagcctatataccctgtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtgtgactttcattactggagatgttgtttctgatgttgctggcggtccctactgaaaaggatgcatgcatgaagactcaaggcaacagtgacttgcacccatttctaacaatgacttgcacccatttctcccgtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttagggagcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctctgggaaaatgttaaagctgtgattatctagttatacctgaataaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcatacaatgtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagactgtccataattgggctgggctgactgcatgagtctcacctttcactgttctcccttaattccctgcctgcctggaagacgtatttcagcttctgcaatgctttgccttgctaaaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggcagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccatacctcacggggagggaggtcagggggatggggcggggaaggaggctgatggaggagttgctgactgcaggtagctggaggcctcagccttcctgggcagcagggatacgggcagggatgtcccctgagcatggtcccacctggaagccagggggctgaccttgacacactcctgaccagtcagtggatggcgctgcagccccttctgtttagtcttcacatcagcaatgaaagagggtgaagttcatggaaatattgtggggacatatcgcatggtttctgttcatgaaatgtccagaaaagacaaacatatacagccagtggctgtggtaaagtgggaatgactgctaatgggcatgaggtttcatttaagggtgatggagatgttctaaaattatatgtggtgaggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactcctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggctaaagatgctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctaccgtttctgcagttctttagagagtgcagaccactttcacatgcagcttctcatttcattctcataacctagaggacgggcacattatcctcctttacagatgagaaaatttccttcaacccctctgtgtcctgtctcgaggggagcagtattgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttccttaagatgcccaccgtgacgggcccagagagtcgacatgcacatggtgacttctctacaatcaatacctccagcagcccccgaaccctgtcccttccaggtactgtttttcccgaatcagagcttcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggattcagggagctgaccactctggacacccgtgaggacagaaatatcacccatttgtgggtatgaaaacacaagaaagcaattcatgacactctatgcaaggttcattattgatgacacggtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttcttttttttttttttttctgagatggagtctcaccgtgtcacccaggctggagtacagtggcgcgatctcagctcactgcaacttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggggctcatgccaagtgcccagcacattggccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaagctgttgttaggattgagatgcttgcttctgatgatgcagaagacagttttaattagtatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcaggttatccaccctcctcagcctcccaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcgaactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttagtctgttgattgcttattttgctgtgcagaagcttttaagtttaattaaatttgaattgtccatttttttttttttttggtcatgtttgcttttgaggactaggccataaatcctttgccgaggccaatatctggaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagatgagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattacgggatcaacatggtagatgatgttgaaattaagcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgtacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtggttcacgcctgtaatcccagcactgtgggacgctgaggcgggaggatcacccgaggtcaggagttcaagaccatcctggccaacgtggcgaaaccccgtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacacacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatattttcatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagatgttttttgtagaattactgcactgctttgcaaaaactatttatttgtccctgctttttatgcctttgaaggtacgtattttcctttttgttcctgcttgtttctatttatctgtcttactctttatatctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacgtaactggttcttgatttttttggtcatattttattacaacctgaattcctgtaaagaaaggagactcatatcctgaagaatgaagacatcaaaagcaaggtgctgtggcaagttagcccttggtggagggtttttcacaactggatatcctgctgtgtagaactgaatacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggtgtatgacccccccccccccccccccgcccacagacacacacaggagacaacccgagagatcactgccagccctgggaaaatgagtttgcctcctaatttctggctcttttccatggtgcattctgccctagactatctgtcatagttttggaagacaaggtaaaacacccagtcgtgaacatacttgctcatacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgattgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctttgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagttgaatgtacctttttcctgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataatctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccaggcatttcagcttgaattagcatccagactcagggttgttgaagaattttcaaattggactagaatgttcactacctaatgaatgtctggatctaagccaaacatggctaaccctactgtcctgcttagtttttacaacagccctataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaacgcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatgtgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaaagtggctgtgatgcaaggaggaaattgtcacaaataaacttggagaaatcatcaaaggctggaagaggaaaaattgtaaaaactactgtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccgggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatatccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaagcccagctactctggaggctgaggcaggagaattgcttgaacccaggaggcagaagttgtggtgagccaagatcataccattacactccagcctgggcaacaagagcaaaactccatctataaataaataaatatccctgagtcccaccattggggataaccgctgtagacatccgagggttttacctctctatttttaaagtgcgtatacattcataaagacacagcatcaggctgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgcattttccacttgccaatgtctcagaaaccttcttcatgtccttcatcaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcacactgcaggacccacccagtctttgaataggaaagcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccagctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatacaacctgctctgcatcctcttgagtgctttttaaacttccctcgtctcctccttcgtttccaggctttctcacccactactcctctttgccgttcctctgcctgactctattaagataaactaatccttggaatttgctgctttgaagttgatgtcggctgggaaactcatacacaggcgtgtcccagtcctgtggtctagaatcaacatagtgagacgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccacgagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctctctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgcaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatatgtgtatgtcacgttaaccagaatggtattcaacaggcatccctaactgcagcagcagctggagaagtaagatttagttgcaaataccaataattcaagcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaaggtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttcttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattctcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccatcataagctgtaactacaaattcaatggaattagtatgaaggtaaggagccagcaggttctggtggctcactgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacggggtttcaccattttggccaggctgatcctgaactcctgacctcaagtgatccacccgcctcagcttcccaaagtgctgggattacagatgtgagccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactctcgcaccatattaactattgcagtatggtgttattattattatgaatatctaatacagttaatatctttgtacgtaggagttttagcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacatgttactccaagatacagtagttctatggtaaggttggaattacattatttcctctctatattgaaatattcagcaactaatttcctgtagcttcatagtaaatcatgctaatgacctcagaggtggaaaccaaggtggtgagactttctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaaacagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctccccataagacccttcacttctctattgacatcattttcaccttcaactccacactcagatactgactcatacatatgattgattctcacctgcctgtgtcttgttgatccaggtctcagcttagaaattacttcctccaggaagctgtctccaagtcctgttcagatatctgtccttatagagcgttttttatctcacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaaatgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacggacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactattagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaaaagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagaggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgacgacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagtgctcttcaaaggagcaattttctaaaattcgaacaagggtgtcatagttaataagatggaattctccttttctttttcttattatattttccaaatcaagggcagtagattccagaactccaatgacgtcaggccactgtactttcaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggtcacagacctctcctggtctgacactgaggagtgaccagtgctgactcagagcagcccatctacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttccaaatttattttcactcacaattcctacatagtcagacaccttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttgaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatatcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgacaaaccaccaacatttccctcccccgccttgactgtgcatggatttgcatatttatagagttaaagaatcacccaccatggttctctttcttatccacattcttgtcttacccatccgtctctgtcactctcctgatatacctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaataacagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctgtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtggccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcagttgcctgttgcacctcacaattagctgcctaagattctaggagagaagcagttggattttatatgtgaaaatgcctctatttgctgcatttttactttttgagaagttgcaagttacatgaaaataaacatactatataagaaaacacggcagatttctcctggtgttttaataattccacgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtatgagggttgaaaaactactagatgctgtgctagctaggtgacaggaccaatgatactcaaacctcagcgccacacaatatacctaggtaacaaacctgcacttgtacccgctgaatctaaaacgaaagttgaaattataaaataaataaataaatgtggtgcttatttttaaaataaatgaacaaaaaaaccccaaagagcttagctaggtgttaagtaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatgacagagtcaactttacctaacttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatattcacatctatatctatactcattcatatatattcatatgtaagattaaactatatgttcaaattgtattctgctttttaaaatcacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataattatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaagccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccctgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcaagatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagaacacagccaaagatccctgcctctcccaatcttctgggcctctttctttaggaaacaaacataaacctgcccaaactgaggttgtaccctttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagtatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctgaattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagaattacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttggggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttggtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattcggctctgtttctttttctaatgagccagtgtggagactggggaagaggaagggattgtttggaaagatcagagcatccaggagaaactgtatggggatgggggcaccactgactgaatcagagcctccagtttgctttgggtgaccacagagggactgaacaaacccctgtgttgtcagtccttagttttgagaatagccttgaccagcacacttgttcactgaggaaggatacgaaaatgcagataagttaaaacaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtttttgtttttgtttttttttcagtagagacggggtttctccatgtaggtcaggctggtcttgaaatctctacctcaggtcatccacttgcctcggtctcccagagtgctgggattacaggcgtgagctaccattcccggcctcaacctactttttaaattaatatgcttcaacacatttccaagccaaaatgacttgtaaaacgttgtacttaaagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaatataattccactgagcatcctcaactttgtgcacattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccatccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcacggatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagccctcctccgccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcgtttccttggaataagacctttaattaatgctcattaagatgcacaaatagcctggccttgaatcctcccagtgtttggttcactctcccctaacttattaaagttgcttctggaagttacatagagacgtgcagttaattcctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattagccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccacta

SEQ ID NO: 1967 - DNA, 554233 bp, Homo sapiens; identical to SEQ ID NO: 1966
